United States Patent
Asfaha et al.

(10) Patent No.: US 12,502,421 B2
(45) Date of Patent: Dec. 23, 2025

(54) ENGINEERED LEUCINE DECARBOXYLASES

(71) Applicant: Syntis Bio, Inc., Boston, MA (US)

(72) Inventors: Jonathan Benjamin Asfaha, Oakland, CA (US); Subhamoy Das, Menlo Park, CA (US); Faye Loan Du, San Jose, CA (US); Stephan Jenne, Foster City, CA (US); Nikki D. Kruse, San Carlos, CA (US); Joyce Liu, Fremont, CA (US); Kerryn McCluskie, Pacifica, CA (US); Roasa Mehmood, Fremont, CA (US); Adam P. Silverman, San Carlos, CA (US); Kristen Jean Vallieu, Las Vegas, NV (US)

(73) Assignee: Syntis Bio, Inc., Boston, MA (US)

( * ) Notice: Subject to any disclaimer, the term of this patent is extended or adjusted under 35 U.S.C. 154(b) by 35 days.

(21) Appl. No.: 18/051,856

(22) Filed: Nov. 1, 2022

(65) Prior Publication Data
US 2023/0277635 A1    Sep. 7, 2023

Related U.S. Application Data

(60) Provisional application No. 63/274,395, filed on Nov. 1, 2021.

(51) Int. Cl.
*A61K 38/51* (2006.01)
*A61P 3/00* (2006.01)
*C12N 9/88* (2006.01)

(52) U.S. Cl.
CPC .............. *A61K 38/51* (2013.01); *A61P 3/00* (2018.01); *C12N 9/88* (2013.01); *C12Y 401/01014* (2013.01)

(58) Field of Classification Search
CPC .............. A61K 38/51; C12N 9/88; A61P 3/00
See application file for complete search history.

(56) References Cited

U.S. PATENT DOCUMENTS

| | | |
|---|---|---|
| 5,605,793 A | 2/1997 | Stemmer |
| 5,811,238 A | 9/1998 | Stemmer |
| 5,830,721 A | 11/1998 | Stemmer |
| 5,834,252 A | 11/1998 | Stemmer |
| 5,837,458 A | 11/1998 | Minshull |
| 5,928,905 A | 7/1999 | Stemmer |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin |
| 6,265,201 B1 | 7/2001 | Wackett |
| 6,277,638 B1 | 8/2001 | Stemmer |
| 6,287,861 B1 | 9/2001 | Stemmer |
| 6,287,862 B1 | 9/2001 | Delcardayre |
| 6,291,242 B1 | 9/2001 | Stemmer |
| 6,297,053 B1 | 10/2001 | Stemmer |
| 6,303,344 B1 | 10/2001 | Patten |
| 6,309,883 B1 | 10/2001 | Minshull |
| 6,319,713 B1 | 11/2001 | Patten |
| 6,319,714 B1 | 11/2001 | Crameri |
| 6,323,030 B1 | 11/2001 | Stemmer |
| 6,326,204 B1 | 12/2001 | Delcardayre |
| 6,335,160 B1 | 1/2002 | Patten |
| 6,335,198 B1 | 1/2002 | Delcardayre |
| 6,337,186 B1 | 1/2002 | Krebber |
| 6,344,356 B1 | 2/2002 | Stemmer |
| 6,352,859 B1 | 3/2002 | Delcardayre |
| 6,355,484 B1 | 3/2002 | Patten |
| 6,358,740 B1 | 3/2002 | Patten |
| 6,358,742 B1 | 3/2002 | Stemmer |
| 6,365,377 B1 | 4/2002 | Patten |
| 6,365,408 B1 | 4/2002 | Stemmer |
| 6,368,861 B1 | 4/2002 | Crameri |
| 6,372,497 B1 | 4/2002 | Stemmer |

(Continued)

FOREIGN PATENT DOCUMENTS

| | | |
|---|---|---|
| WO | 1995022625 A1 | 8/1995 |
| WO | 1995033836 A1 | 12/1995 |

(Continued)

OTHER PUBLICATIONS

Brunetti-Pierri et al., Human Molecular Genetics, vol. 20 (4), 2011, pp. 631-640 (Year: 2011).*
Sahutoglu., Turkish Journal of Chemistry. 2020, vol. 44, pp. 817-832 (Year: 2020).*
Altschul, S.F. et al. (Oct. 5, 1990). "Basic Local Alignment Search Tool," J. Mol. Biol. 215(3):403-410.
Altschul, S.F.et al. (Sep. 1, 1997). "Gapped BLAST and PSI-BLAST: A New Generation of Protein Database Search Programs," Nucleic Acids Res. 25(17):3389-3402.
Beaucage, S.L. et al. (1981). "Deoxynucleoside Phosphoramidites—A New Class of Key Intermediates for Deoxypolynucleotide Synthesis," Tetrahedron Lett. 22(20):1859-1862.
Black, M.E. et al. (Apr. 1996). "Creation Of Drug-Specific Herpes Simplex Virus Type 1 Thymidine Kinase Mutants For Gene Therapy," Proc Natl Acad Sci USA 93:3525-3529.

(Continued)

*Primary Examiner* — Thea D'Ambrosio
*Assistant Examiner* — Claudia Espinosa
(74) *Attorney, Agent, or Firm* — MORRISON & FOERSTER LLP

(57) ABSTRACT

The present invention provides engineered leucine decarboxylase (LDC) polypeptides and compositions thereof, as well as polynucleotides encoding the engineered leucine decarboxylase polypeptides. In some embodiments, the engineered leucine decarboxylase polypeptides display enhanced catalytic activity, as well as reduced sensitivity to proteolysis, and/or increased tolerance to low pH environments. In some embodiments, the engineered leucine decarboxylase polypeptides are optimized to provide improved storage stability. The present invention also provides methods for the use of the compositions comprising the engineered leucine decarboxylase polypeptides for therapeutic and industrial purposes.

20 Claims, 25 Drawing Sheets

Specification includes a Sequence Listing.

(56) References Cited

U.S. PATENT DOCUMENTS

| | | |
|---|---|---|
| 6,376,246 B1 | 4/2002 | Crameri |
| 6,379,964 B1 | 4/2002 | Del |
| 6,387,702 B1 | 5/2002 | Stemmer |
| 6,391,552 B2 | 5/2002 | Stemmer |
| 6,391,640 B1 | 5/2002 | Minshull |
| 6,395,547 B1 | 5/2002 | Stemmer |
| 6,406,855 B1 | 6/2002 | Patten |
| 6,406,910 B1 | 6/2002 | Patten |
| 6,413,745 B1 | 7/2002 | Patten |
| 6,413,774 B1 | 7/2002 | Stemmer |
| 6,420,175 B1 | 7/2002 | Stemmer |
| 6,423,542 B1 | 7/2002 | Crameri |
| 6,426,224 B1 | 7/2002 | Crameri |
| 6,436,675 B1 | 8/2002 | Welch |
| 6,444,468 B1 | 9/2002 | Stemmer |
| 6,455,253 B1 | 9/2002 | Patten |
| 6,479,652 B1 | 11/2002 | Crameri |
| 6,482,647 B1 | 11/2002 | Stemmer |
| 6,483,011 B1 | 11/2002 | Stemmer |
| 6,484,105 B2 | 11/2002 | Zhang |
| 6,489,146 B2 | 12/2002 | Stemmer |
| 6,500,617 B1 | 12/2002 | Stemmer |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne |
| 6,521,453 B1 | 2/2003 | Crameri |
| 6,528,311 B1 | 3/2003 | Delcardayre |
| 6,537,746 B2 | 3/2003 | Arnold |
| 6,573,098 B1 | 6/2003 | Stemmer |
| 6,576,467 B1 | 6/2003 | Stemmer |
| 6,579,678 B1 | 6/2003 | Patten |
| 6,586,182 B1 | 7/2003 | Patten |
| 6,602,986 B1 | 8/2003 | Stemmer |
| 6,605,430 B1 | 8/2003 | Affholter |
| 6,613,514 B2 | 9/2003 | Patten |
| 6,653,072 B1 | 11/2003 | Patten |
| 6,686,515 B1 | 2/2004 | Lassner |
| 6,703,240 B1 | 3/2004 | Stemmer |
| 6,716,631 B1 | 4/2004 | Delcardayre |
| 6,825,001 B2 | 11/2004 | Wackett |
| 6,902,922 B2 | 6/2005 | Ness |
| 6,917,882 B2 | 7/2005 | Selifonov |
| 6,946,296 B2 | 9/2005 | Patten |
| 6,961,664 B2 | 11/2005 | Selifonov |
| 6,995,017 B1 | 2/2006 | Stemmer |
| 7,012,312 B2 | 3/2006 | Iwasaki |
| 7,024,312 B1 | 4/2006 | Selifonov |
| 7,058,515 B1 | 6/2006 | Selifonov |
| 7,105,297 B2 | 9/2006 | Minshull |
| 7,148,054 B2 | 12/2006 | Delcardayre |
| 7,220,566 B2 | 5/2007 | Ness |
| 7,288,375 B2 | 10/2007 | Stemmer |
| 7,384,387 B1 | 6/2008 | Raillard |
| 7,421,347 B2 | 9/2008 | Selifonov |
| 7,430,477 B2 | 9/2008 | Selifonov |
| 7,462,469 B2 | 12/2008 | Bass |
| 7,531,341 B1 | 5/2009 | Vellard |
| 7,534,564 B2 | 5/2009 | Patten |
| 7,534,595 B2 | 5/2009 | Vellard |
| 7,553,653 B2 | 6/2009 | Kakkis |
| 7,560,263 B2 | 7/2009 | Kakkis |
| 7,620,500 B2 | 11/2009 | Mundorff |
| 7,620,502 B2 | 11/2009 | Selifonov |
| 7,629,157 B2 | 12/2009 | Davis |
| 7,629,170 B2 | 12/2009 | Delcardayre |
| 7,702,464 B1 | 4/2010 | Emig |
| 7,747,391 B2 | 6/2010 | Gustafsson |
| 7,747,393 B2 | 6/2010 | Fox |
| 7,751,986 B2 | 7/2010 | Gustafsson |
| 7,776,598 B2 | 8/2010 | Patten |
| 7,783,428 B2 | 8/2010 | Gustafsson |
| 7,795,030 B2 | 9/2010 | Minshull |
| 7,853,410 B2 | 12/2010 | Selifonov |
| 7,868,138 B2 | 1/2011 | Stemmer |
| 7,873,477 B1 | 1/2011 | Gustafsson |
| 7,873,499 B2 | 1/2011 | Selifonov |
| 7,904,249 B2 | 3/2011 | Selifonov |
| 7,957,912 B2 | 6/2011 | Selifonov |
| 7,981,614 B2 | 7/2011 | Stemmer |
| 8,014,961 B2 | 9/2011 | Bass |
| 8,029,988 B2 | 10/2011 | Crameri |
| 8,048,674 B2 | 11/2011 | Minshull |
| 8,058,001 B2 | 11/2011 | Crameri |
| 8,076,138 B2 | 12/2011 | Delcardayre |
| 8,108,150 B2 | 1/2012 | Mundorff |
| 8,170,806 B2 | 5/2012 | Selifonov |
| 8,224,580 B2 | 7/2012 | Mundorff |
| 8,377,681 B2 | 2/2013 | Delcardayre |
| 8,383,346 B2 | 2/2013 | Colbeck |
| 8,457,903 B1 | 6/2013 | Emig |
| 8,504,498 B2 | 8/2013 | Fox |
| 8,589,085 B2 | 11/2013 | Selifonov |
| 8,762,066 B2 | 6/2014 | Fox |
| 8,768,871 B2 | 7/2014 | Fox |
| 9,593,326 B2 | 3/2017 | Clark |
| 9,665,694 B2 | 5/2017 | Cope |
| 9,684,771 B2 | 6/2017 | Cope |
| 12,241,100 B2 | 3/2025 | Liu |
| 2005/0260724 A1 | 11/2005 | Ben-bassat |
| 2008/0220990 A1 | 9/2008 | Fox |
| 2009/0312196 A1 | 12/2009 | Colbeck |
| 2011/0082055 A1 | 4/2011 | Fox |
| 2012/0177722 A1 | 7/2012 | Weiner |
| 2013/0005012 A1 | 1/2013 | Yu |
| 2013/0039898 A1 | 2/2013 | Okhamafe |
| 2013/0340119 A1 | 12/2013 | Plesch |
| 2014/0005057 A1 | 1/2014 | Clark |
| 2014/0214391 A1 | 7/2014 | Cope |
| 2014/0221216 A1 | 8/2014 | Cope |
| 2015/0050658 A1 | 2/2015 | Cho |
| 2015/0133307 A1 | 5/2015 | Zhang |
| 2015/0134315 A1 | 5/2015 | Sarmiento |
| 2016/0244787 A1 | 8/2016 | Chan |
| 2021/0238575 A1 | 8/2021 | Liu |
| 2024/0018504 A1 | 1/2024 | Liu |

FOREIGN PATENT DOCUMENTS

| | | |
|---|---|---|
| WO | 1996000787 A1 | 1/1996 |
| WO | 1997000078 A1 | 1/1997 |
| WO | 1997035966 A1 | 10/1997 |
| WO | 1998027230 A1 | 6/1998 |
| WO | 2000042651 A1 | 7/2000 |
| WO | 2001075767 A2 | 10/2001 |
| WO | 2009152336 A1 | 12/2009 |
| WO | 2012122333 A1 | 9/2012 |
| WO | 2016201380 A1 | 12/2016 |
| WO | 2021158686 A1 | 8/2021 |
| WO | 2023077169 A2 | 5/2023 |

OTHER PUBLICATIONS

Botstein, D. et al. (Sep. 20, 1985). "Strategies And Applications Of In Vitro Mutagenesis," Science 229 (4719):1193-1201.

Cadwell, RC et al. (1994). "Mutagenic PCR," PCR Methods Appl. 3:S136-S140.

Carter, P. (1986). "Site-Directed Mutagenesis," Biochem J. 237:1-7.

Christians, F.C. et al. (Mar. 1999). "Directed Evolution Of Thymidine Kinase For AZT Phosphorylation Using DNA Family Shuffling," Nat. Biotechnol. 17:259-264.

Crameri, A. et al. (Mar. 1996). "Improved Green Fluorescent Protein By Molecular Evolution Using DNA Shuffling," Nat. Biotechnol. 14(3):315-319, 17 pages.

Crameri, A. et al. (May 1997). "Molecular Evolution Of An Arsenate Detoxification Pathway By DNA Shuffling," Nat. Biotechnol. 15(5):436-438.

Crameri, A., et al. (1998). "DNA Shuffling Of A Family Of Genes From Diverse Species Accelerates Directed Evolution," Nature 391:288-291.

(56) References Cited

OTHER PUBLICATIONS

Dale, S.J. et al. (1996). "Oligonucleotide-Directed Random Mutagenesis Using The Phosphorothioate Method," Methods Mal. Biol. 57:369-374.
Deboer, H.A. et al. (Jan. 1983). "The tac Promoter: A Functional Hybrid Derived from the trp and lac Promoters," Proc. Natl. Acad. Sci. U.S.A. 80:21-25.
Extended European Search Report dated Jan. 25, 2024, for European Patent Application No. 21751078.3, 11 pages.
GenBank Accession No. RPI63066.1 dated Nov. 25, 2018, 2 pages.
Guo, M. et al. (Jan. 2014). "Genomic Evolution of 11 Type Strains Within Family Planctomycetaceae," PloS One 9 (1):e86752, 1-11.
Guo, Z. et al. (Nov. 1995). "3'-End-Forming Signals of Yeast mRNA," Mal. Cell. Biol. 15(11):5983-5990.
Henikoff, S. et al. (Nov. 15, 1992). "Amino Acid Substitution Matrices From Protein Blocks," Proc. Nat'l Acad. Sci. USA 89:10915-10919.
Ikeda, K. et al. (2005, e-pub. Jun. 28, 2005). "Phenylalanine Ammonia-Lyase Modified With Polyethylene Glycol: Potential Therapeutic Agent For Dhenylketonuria," Amino Acids 29:283-287.
International Preliminary Report on Patentability issued on Jul. 28, 2022 for PCT Application No. PCT/US2021/0165450, filed on Feb. 3, 2021, 6 pages.
International Preliminary Report on Patentability issued on May 2, 2024 for PCT Application No. PCT/US2022/079089, filed on Nov. 1, 2022, 7 pages.
International Search Report and Written Opinion of the International Searching Authority mailed on Jul. 12, 2021 for PCT Application No. PCT/US2021/16450 filed on Feb. 3, 2021, 11 pages.
International Search Report and Written Opinion of the International Searching Authority mailed on Jun. 6, 2023 for PCT Application No. PCT/US2022/079089 filed on Nov. 1, 2022, 11 pages.
Kramer, B. et al. (Oct. 1984). "Different Base/Base Mismatches Are Corrected With Different Efficiencies By The Methyl-Directed DNA Mismatch-Repair System Of *E. Coli*," Cell 38(3):879-887.
Lambertos et al. (Mar. 31, 2018, e-pub. Nov. 4, 2017). "The Mouse Gm853 Gene Encodes A Novel Enzyme: Leucine Decarboxylase," Biochimica et Biophysica Acta 1862(3):365-376.
Ling, M. et al. (1997). "Approaches to DNA Mutagenesis:An Overview," Anal. Biochem. 254(AB972428):157-178.
Matthes, H.W.D. et al. (Apr. 1984). "Simultaneous Rapid Chemical Synthesis Of Over One Hundred Oligonucleotides On A Rnicroscale," EMBO J. 3(4):801-805.
Menkes, J.H. et al. (1954). "A New Syndrome: Progressive Familial Infantile Cerebral Dysfunction Associated With an Unusual Urinary Substance," Pediatrics 14(20):462-466, 1 page.
Minshull, J. et al. (1999). "Protein Evolution By Molecular Breeding," Curr. Op. Chem. Biol. 3(3):284-290.
NCBI Accession No. WP_051769113.1 dated Jan. 13, 2018, 1 page.
NCBI Accession No. WP_051812394.1 dated Aug. 16, 2015, 1 page.
NCBI Accession No. WP_052681825.1 dated Jan. 12, 2018, 1 page.
NCBI Accession No. WP_101384472.1 dated Dec. 27, 2017, 1 page.
NCBI Accession No. WP_104818078.1 dated Mar. 2, 2018, 1 page.
Needleman, S.B. et al. (Mar. 1970). "A General Method Applicable to the Search for Similarities in the Amino Acid Sequence of Two Proteins," J. Mol. Biol. 48:443-453.
Pearson, W.R. et al. (Apr. 1988). "Improved Tools For Biological Sequence Comparison," Proc. Natl. Acad. Sci. USA 85(8):2444-2448.
Peters, J.M. et al. (Oct. 7, 2011, e-pub. Apr. 10, 2013). "Bacterial Transcription Terminators: The RNA 3'-End Chronicles," J Mol Biol. 412(5):793-813.
Romanos, M.A. et al. (1992). "Foreign Gene Expression In Yeast: A Review," Yeast 8:423-488.
Schadewaldt, P. et al. (1997). "Metabolism Of Branched-Chain Amino Acids In Maple Syrup Urine Disease," Eur. J. Pediatr. 156(Suppl. 1): S62-S66.
Simonen, M. et al. (Mar. 1993). "Protein Secretion in *Bacillus* Species," Microbiological Reviews 57(1):109-137.
Skvorak, K. et al. (Aug. 9, 2023). "Oral Enzyme Therapy for Maple Syrup Urine Disease (MSUD) Suppressgges Plasma Leucine Levels In Intermediate MSUD Mice And Healthy Nonhuman Primates," Journal Of Inherited Metabolic Disease 46(6):1089-1103.
Skvorak, K.J. (2009, e-pub. Mar. 9, 2009). "Animal Models Of Maple Syrup Urine Disease," Inherit. Metab. Dis. 32(2):229-246, 18 pages.
Smith, M. (1985). "In Vitro Mutagenesis," Ann. Rev. Genet. 19:423-462.
Smith, T.F. et al. (1981). "Comparison of Biosequences," Advances in Appl. Math. 2:482-489.
Stemmer, W.P.C. (Aug. 4, 1994). "Rapid Evolution Of A Protein In Vitro By DNA Shuffling", Nature 370:389-391.
Stemmer, W.P.C. (Oct. 1994). "DNA Shuffling by Random Fragmentation and Reassembly: In vitro Recombination for Molecular volution," Proc. Natl. Acad. Sci. USA 91:10747-10751.
Taguchi, Y. al. (Apr. 1984). "Purification Of Histidine Decarboxylase From The Liver Of Fetal Rats And Its Lmmunochemical And Lmmunohistochemical Characterization," The Journal Of Biological Chemistry 259 (8):5214-5221.
Tully, B.J. et al. (Jan. 16, 2018). "The Reconstruction of 2,631 Draft Metagenome—Assembled Genomes from the Global Oceans," Scientific Data 5(170203), 8 pages.
UniProt Accession No. A0A327WPB0 dated Oct. 10, 2018, 2 pages.
UniProtKB Accession No. A0A2N3UZI5 dated Apr. 25, 2018, 1 page.
Villa-Komaroff, L. et al. (Aug. 1978). "A Bacterial Clone Synthesizing Proinsulin," Proc. Natl Acad. Sci. USA 75 (8):3727-3731.
Wells, J.A. et al. (1985). "Cassette Mutagenesis: An Efficient Method For Generation Of Multiple Mutations At Defined Sites," Gene 34(2-3):315-323.
Zhang, J-H. et al. (Apr. 1997). "Directed Evolution Of A Fucosidase From A Galactosidase By DNA Shuffling And Screening," Proc. Nat Acad. Sci. U.S.A. 94:4504-4509.
Zhao, H. et al. (Mar. 2, 1998). "Molecular Evolution By Staggered Extension Process (Step) In Vitro Recombination," Nat. Biotechnol. 6:258-261, 180 pages.
Martins, P.D. et al. (2018, e-pub. Aug. 7, 2018). "Viral And Metabolic Controls On High Rates Of Microbial Sulfur And Carbon Cycling In Wetland Ecosystems," Microbiome 6(138):1-17.
Strub, C. et al. (Jul. 13, 2004). "Mutation Of Exposed Hydrophobic Amino Acids To Arginine To Increase Protein Stability," BMC Biochem. 5(9):1-6.

\* cited by examiner

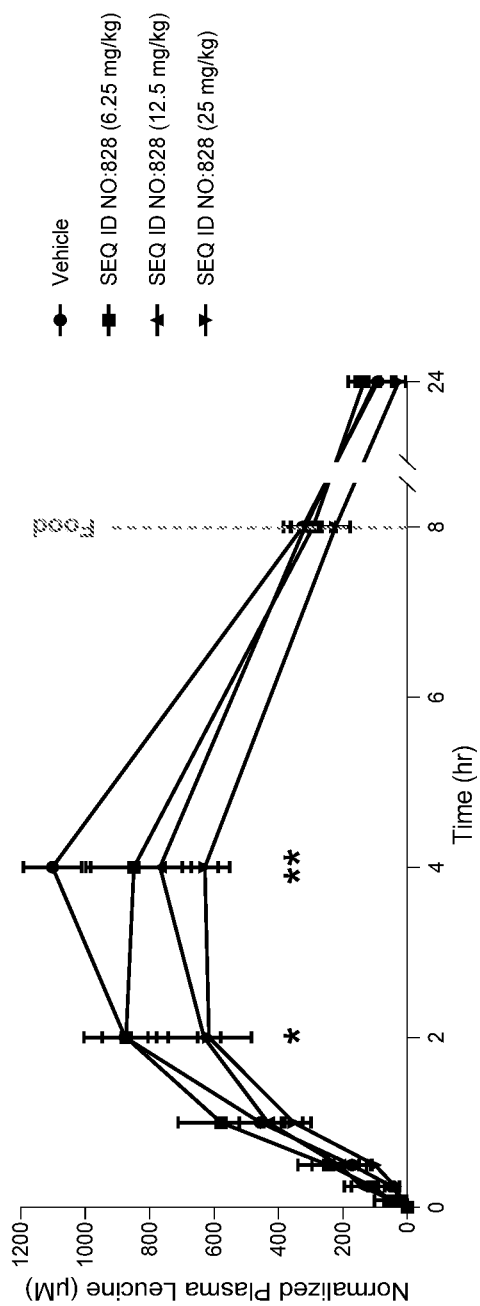
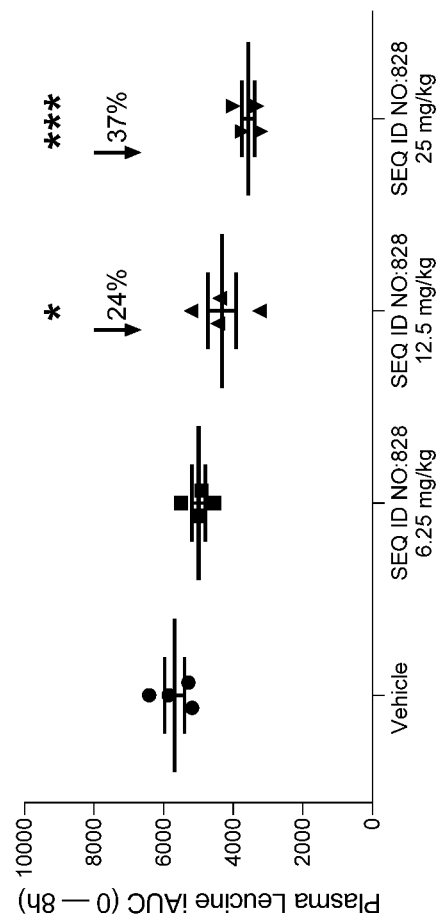
FIG 9A
FIG 9B

ENGINEERED LEUCINE DECARBOXYLASES

CROSS-REFERENCE TO RELATED APPLICATIONS

This application claims the benefit under 35 U.S.C. § 119(e) of U.S. Provisional Application No. 63/274,395, filed Nov. 1, 2021, which is incorporated by reference herein in its entirety.

REFERENCE TO A SEQUENCE LISTING, A TABLE, OR A COMPUTER PROGRAM

The Sequence Listing concurrently submitted herewith via EFS-Web as file name CX7-221US2_ST26.xml, created on Oct. 30, 2022 with a file size of 2.08 megabytes, is part of the specification and is hereby incorporated by reference herein.

TECHNICAL FIELD

The present disclosure relates to engineered leucine decarboxylase (LDC) polypeptides, compositions thereof, and polynucleotides encoding the engineered leucine decarboxylase polypeptides. The present disclosure also provides methods of using the engineered leucine decarboxylase polypeptides for therapeutic and industrial purposes.

BACKGROUND OF THE INVENTION

Maple syrup urine disease (MSUD), also referred to as "leucineuria," branched chain alpha-leucine dehydrogenase deficiency," and "BCKD deficiency," is a rare inherited aminoacidopathy secondary to dysfunction in the branched chain keto acid dehydrogenase (BCKDH) complex that is involved in the catabolic pathway of leucine, isoleucine and valine (i.e., branched chain amino acids). It was first described in 1954 by Menkes et al., Pediatrics, 1954, 14:462-467, and named due to the distinctive, sweet odor of the urine of affected newborns. It is also characterized by poor feeding, vomiting, lethargy, abnormal movements (e.g., hyper or hypotonia), and delayed development. Without treatment, the disease can progress to encephalopathy, seizures, coma, permanent neurologic damage, and death. Later in life, developmental delays, learning problems, seizures, and motor difficulties are common. There are four common forms that are classified based on the signs and symptoms of disease. The most common and severe type is the "classic" type, which becomes apparent within two weeks after birth. The other types are intermediate MSUD, intermittent MSUD, and thiamine-responsive MSUD. In the classic form, the disease becomes apparent after the newborn has ingested milk containing protein. This results in an increase in isoleucine, leucine, and valine in the body, which becomes toxic to the brain. In the intermittent form, brain damage occurs during times of physical stress (e.g., infection, fever or not eating for a prolonged period), which leads to metabolic decompensation.

Diagnostic testing for MSUD in newborns includes blood and urine amino acid tests to determine the leucine, isoleucine, alloisoleucine, and valine concentrations in these fluids. If MSUD is identified, there will be signs of ketosis and acidosis. Upon diagnosis and during symptomatic episodes, treatment involves eating a protein-free diet and correction of the metabolic consequences associated with the elevated amino acid levels. The use of a special intravenous solution decreases the leucine level (the most toxic) and corrects energy deficits.

In addition to MSUD, other disorders of leucine metabolism and branched amino acids include isovaleric acidemia and 3-methylcrotonylglycinuria (also referred to as 3-methylcrotonyl-CoA carboxylase deficiency). Current treatment for these types of disorders involves dietary restriction of leucine and other branched-chain amino acids (BCAAs) and/or restriction of protein intake. Deficient levels of enzymes involved in BCAA metabolism result in the toxic accretion of BCAAs and their related metabolites in the cerebrospinal fluid, blood, and tissues. Without treatment or constant attentive care, this leads to numerous and serious side effects (e.g., neurological dysfunction, seizures, and infant death). Although some BCAA turnover via renal clearance (resulting in the typical sweet, maple syrup smell of affected patients' urine), it is not sufficient to provide relief from the accumulation of toxic amino acid levels in the body (See, Schadewalt and Wendel, Eur. J. Pediatr., 1997, 156(Suppl. 1): S62-66; and Skvorak, J. Inherit. Metab. Dis., 2009, 32(2):229-46).

SUMMARY OF THE INVENTION

The present invention provides engineered leucine decarboxylase (LDC) polypeptides and compositions thereof, as well as polynucleotides encoding the engineered leucine decarboxylase polypeptides. In some embodiments, the leucine decarboxylase polypeptides are engineered to have an improved property, including enhanced catalytic activity, reduced sensitivity to proteolysis, and/or increased tolerance to low pH environments. In some embodiments, the engineered leucine decarboxylase polypeptides are engineered to display improved storage stability. The present invention also provides methods of using the engineered leucine decarboxylase polypeptides and compositions thereof for therapeutic and industrial purposes.

In one aspect, the present invention is directed to engineered leucine decarboxylase polypeptides and biologically active fragments and analogs thereof having improved properties when compared to a wild-type leucine decarboxylase enzyme or a reference leucine decarboxylase polypeptide under essentially the same conditions.

In some embodiments, an engineered leucine decarboxylase polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence corresponding to SEQ ID NO: 828 or 888, wherein the amino acid sequence comprises one or more substitutions relative to a reference sequence corresponding to SEQ ID NO: 828 or 888.

In some embodiments, an engineered leucine decarboxylase polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to the reference sequence corresponding to SEQ ID NO: 828, wherein the amino acid sequence comprises one or more substitutions relative to the reference sequence corresponding to SEQ ID NO: 828.

In some embodiments, the amino acid sequence of the engineered leucine decarboxylase polypeptide comprises at least a substitution at amino acid position 5, 19, 33, 41, 47, 51, 55, 64, 141, 170, 173, 187, 198, 200, 202, 267, 270, 272, 290, 312, 353, 357, 383, or 384, or combinations thereof, wherein the amino acid positions are relative to the reference sequence corresponding to SEQ ID NO: 828.

In some embodiments, the amino acid sequence of the engineered leucine decarboxylase polypeptide comprises at least a substitution at amino acid positions 33, 55, 64, 126, 270, or 357, or combinations thereof, wherein the amino acid positions are relative to the reference sequence corresponding to SEQ ID NO: 828 or 888. In some embodiments, the amino acid sequence of the engineered leucine decarboxylase polypeptide comprises substitutions on at least two amino acid positions of 33, 55, 64, 126, 270, and 357, wherein the amino acid positions are relative to the reference sequence corresponding to SEQ ID NO: 828 or 888. In some embodiments, the amino acid sequence of the engineered leucine decarboxylase polypeptide substitutions on at least at amino acid positions 33, 55, 64, 126, 270, and 357 wherein the amino acid positions are relative to the reference sequence corresponding to SEQ ID NO: 828 or 888. In some embodiments, the substitutions at amino acid positions 33, 55, 64, 126, 270, and/or 357 are selected from 33L, 55I, 64N, 126A, 270L, and 357S.

In some further embodiments, the engineered leucine decarboxylase comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 828, and wherein the amino acid sequence comprises at least a substitution or substitution set at amino acid position 170/270/383, 270, 41/173, 272, 5/141/272/383, 41/383, 41/141/187/272/290, 41/141/173/290, 5/272/383, 5/41/173/272/383, 41/141, 141/272, 353/384, 272/383, 41/141/173, 41/272/383, 41/141/187/200/202/272, 33/55/64/126/270/357, 33/126/353/357, 55/64/267/35/384, 33/64/357, 126/267, 64/267/353/384, 33/55/64/357, 19/64/126/267, 55/267, 33/126/267/270/312/357, 19/33/55/353/357/384, 19/33/126, 126/312, 126/198/202/267/312, 126/353, 55/126, 126/270/384, 33/64/353/357, 19/267, 51/55/267/270/353, 33/126/267/270, 19/55/64/126/267/270/353, 19/33/126/270/353/357/384, 19/33/64/267/353, 126/353/384, 126/270/312/353/384, 19/33/55/126, 33/357, 47/51/64/126/353/384, 126, or 126/270, wherein the amino acid positions are relative to the reference sequence corresponding to SEQ ID NO: 828.

In some embodiments, the engineered leucine decarboxylase polypeptide comprises an amino acid sequence having at least 80%, 85%, 86%, 87%, 88%, 89%, 90%, 91%, 92%, 93%, 94%, 95%, 96%, 97%, 98%, 99%, or more sequence identity to SEQ ID NO: 888.

In some embodiments, the engineered leucine decarboxylase polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or more sequence identity to SEQ ID NO: 888, wherein the amino acid sequence comprises one or more substitutions relative to the reference sequence corresponding to SEQ ID NO: 888.

In some embodiments, the amino acid sequence of the engineered leucine decarboxylase polypeptide comprises at least a substitution at amino acid position 5, 19, 33, 41, 47, 51, 55, 64, 141, 170, 173, 187, 198, 200, 202, 267, 270, 272, 290, 312, 353, 357, 383, or 384, or combinations thereof, wherein the amino acid positions are relative to the reference sequence corresponding to SEQ ID NO: 888.

In some embodiments, the amino acid sequence of the engineered leucine decarboxylase polypeptide comprises amino acid residue 5V, 19L, 33L, 41D, 47F, 51E, 55I, 64S/N, 141P, 170P, 173I, 187L, 198G, 200S, 202H, 267L, 270L/T, 272A, 290I, 312T, 353E, 357S/C, 383S, or 384W, or combinations thereof, wherein the amino acid positions are relative to the reference sequence corresponding to SEQ ID NO: 888.

In some further embodiments, the engineered leucine decarboxylase polypeptide comprises an amino acid sequence comprising at least 80%, 85%, 86%, 87%, 88%, 89%, 90%, 91%, 92%, 93%, 94%, 95%, 96%, 97%, 98%, 99%, or more sequence identity to SEQ ID NO: 888, wherein the amino acid sequence comprises at least a substitution or substitution set at amino acid position 64/173/202/353/384, 41/141/272/353, 141/202/272/353/357, 173/202/357, 202/353, 5/51/173/272/353/384, 51/202/272/357, 141/173/272, 272, 41/173/384, 41/64/141/353/357/383, 141/173/202, 5/51/64/202/353, 357, 64, 5/41/141, 41/141/173/202/353, 353, 202/357, 51/141/202/272/353, 202, 51/141/173/353/384, 41/141/173/202/272/353/383/384, 64/202/357, 5/64/353/383/384, 41/272/353/383, 41/173/272/353/357, 51/141/272/353/357/383/384, 41/353/357, 173/272/353/357, 5/41/64/173/353/357, 64/173/357, 51/272, 51/64/357/384, 51/141/173/272/353, 64/202/272/353/357/384, 51/272/357, 51/173/272/353/384, 353/384, 202/272/357, 64/141/173/202/353/357, 5/41/51/202/357/383, 5/51/173/272/383, 41/141/272, 51/173, 5/353, 41/64/173/272/353/383, 5/64/173/272/353, 51/64, 41/357/383, 41/173/353/357, 202/272/383, 202/272, 353/357, 41/173/202/272/357, 141/173/202/272/353/357, 64/141/202, or 5/173/272, wherein the amino acid sequence comprises one or more substitutions relative to the reference sequence corresponding to SEQ ID NO: 888.

In some embodiments, the engineered leucine decarboxylase polypeptide comprises an amino acid sequence comprising at least one substitution or substitution set of an engineered leucine decarboxylase provided in Tables 12-1 and 12-2, wherein the substitution or substitution set is relative to the reference sequence corresponding to SEQ ID NO: 12.

In some embodiments, the engineered leucine decarboxylase polypeptide comprises an amino acid sequence comprising at least one substitution or substitution set of an engineered leucine decarboxylase provided in Tables 12-1 and 12-2, wherein the substitution or substitution set is relative to the reference sequence corresponding to SEQ ID NO: 828 or 888.

In some embodiments, the engineered leucine decarboxylase polypeptide comprises a amino acid sequence of an engineered leucine decarboxylase provided in Tables 12-1 and 12-2.

In some embodiments, the engineered leucine decarboxylase polypeptide comprises an amino acid sequence comprising an even-numbered SEQ ID NO. of SEQ ID NOS: 854-1064.

In some embodiments, the engineered leucine decarboxylase polypeptide described herein exhibits one or more improved properties as compared to the wild-type Planctomycetaceae species leucine decarboxylase or the engineered leucine decarboxylase having the sequence corresponding to SEQ ID NO: 12. In some embodiments, the engineered leucine decarboxylase polypeptide described herein exhibits an improved property selected from (i) increased activity on leucine, (ii) increased resistance to proteolysis, (iii) increased tolerance to low pH environments, or (iv) increased thermostability, or any combinations thereof, compared to the wild-type Planctomycetaceae species leucine decarboxylase or the leucine decarboxylase having the amino acid sequence corresponding to SEQ ID NO: 12.

In a further aspect, the present disclosure also provides recombinant polynucleotides encoding at least one engineered leucine decarboxylase polypeptide described herein. In some embodiments, the recombinant polynucleotide comprises a polynucleotide sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to the polynucleotide sequence corresponding to an odd-numbered SEQ ID NO. of SEQ ID NOS: 853-1063, wherein the recombinant polynucleotide encodes a polypeptide having leucine decarboxylase activity. In some embodiments, the recombinant polynucleotide comprises the polynucleotide sequence comprising any of the odd-numbered SEQ ID NO. of SEQ ID NOS: 15-851.

In some additional embodiments, the recombinant polynucleotide sequence is operably linked to a control sequence. In some embodiments, the recombinant polynucleotide sequence is codon-optimized.

In another aspect, the present disclosure also provides expression vectors comprising at least one recombinant polynucleotide sequence provided herein. In some embodiments, the expression vectors further comprise at least one control sequence. In some embodiments, the control sequence comprises a promoter. In some further embodiments, the promoter is a heterologous promoter.

In another aspect, the present further provides host cells transformed with at least one polynucleotide sequence and/or comprising an expression vector provided herein. In some embodiments, the host cells are transformed with a polynucleotide sequence provided herein. In some further embodiments, the host cells comprise an expression vector provided herein. In some embodiments, the host cell is *E. coli*.

In another aspect, the present disclosure also provides methods of producing an engineered leucine decarboxylase polypeptide in a host cell comprising culturing a host cell comprising at least one expression vector provided herein, under suitable culture conditions, such that at least one engineered leucine decarboxylase polypeptide is produced. In some embodiments, the methods further comprise recovering at least one engineered leucine decarboxylase polypeptide from the culture and/or host cells. In some additional embodiments, the methods further comprise the step of purifying said at least one engineered leucine decarboxylase polypeptide.

In another aspect, the present disclosure provides a composition comprising at least one engineered leucine decarboxylase polypeptide. In some embodiments, the composition is a pharmaceutical composition comprising at least one engineered leucine decarboxylase polypeptide. In some embodiments, the pharmaceutical composition includes at least one pharmaceutically acceptable excipient and/or carrier. In some embodiments, the pharmaceutical composition comprising at least one engineered leucine decarboxylase polypeptide is suitable for oral or parenteral administration. In some embodiments, the composition is in the form of a pill, tablet, capsule, gelcap, liquid, or emulsion. In some additional embodiments, the composition is suitable for parenteral administration into a mammal, particularly a human patient. In some embodiments, the composition comprises at least one additional therapeutically effective compound.

In some embodiments, the present disclosure also provides a composition comprising at least one polynucleotide encoding an engineered leucine decarboxylase polypeptide disclosed herein, wherein the polynucleotide is suitable for use in gene therapy. In some embodiments, the composition comprises an expression vector comprising at least one polynucleotide encoding an engineered polypeptide disclosed herein, wherein the expression vector is a gene therapy vector suitable for use in treatment of diseases or conditions associated with elevated levels of plasma leucine, isoleucine, alloisoleucine and/or ketoisocaproic acid. In some embodiments, the composition is suitable for use in mRNA therapy.

In a further aspect, the present disclosure provides methods for treating and/or preventing the symptoms of a disease or condition associated with elevated plasma leucine, isoleucine, alloisoleucine and/or ketoisocaproic acid levels. In some embodiments, a method of treating and/or preventing the symptoms of a disease or condition associated with elevated plasma leucine, isoleucine, alloisoleucine and/or ketoisocaproic acid levels comprises administering to a subject in need thereof an effective amount of an engineered leucine decarboxylase to decrease levels of plasma leucine, isoleucine, alloisoleucine and/or ketoisocaproic acid in the subject. In some embodiments, the disease or condition associated with elevated plasma leucine, isoleucine, alloisoleucine and/or ketoisocaproic acid levels is maple syrup urine disease, isovaleric acidemia, or 3-methylcrotonyl-CoA carboxylase deficiency.

In some embodiments, also provided herein are methods of reducing plasma leucine, isoleucine, alloisoleucine and/or ketoisocaproic acid levels in a subject, comprising administering to a subject in need thereof an effective amount of an engineered leucine decarboxylase. In some embodiments, the subject in need thereof has maple syrup urine disease, isovaleric acidemia, or 3-methylcrotonyl-CoA carboxylase deficiency.

In some embodiments for a method of treating and/or preventing the symptoms of a disease or condition associated with elevated plasma leucine, isoleucine, alloisoleucine and/or ketoisocaproic acid levels, or for a method of reducing plasma leucine, isoleucine, alloisoleucine and/or ketoisocaproic acid levels in a subject, the engineered leucine decarboxylase is administered at a dose of 1 mg/kg to 500 mg/kg, 1 mg/kg to 400 mg/kg, or 1 mg/kg to 200 mg/kg. In some embodiments, the engineered leucine decarboxylase is administered at a dose of 1 mg/kg to less than 25 mg/kg. In some embodiments, the engineered leucine decarboxylase is administered at a dose of 5 mg/kg to less than 25 mg/kg. In some embodiments, the engineered leucine decarboxylase is administered at a dose of about 6.25 mg/kg to about 12.5 mg/kg.

In some embodiments, the engineered leucine decarboxylase is administered to a subject in need thereof in an effective amount to reduce plasma leucine, isoleucine, valine, methionine, cysteine, phenylalanine, alloisoleucine, and/or ketoisocaproic acid levels. In some embodiments, the engineered leucine decarboxylase is administered to a subject in need thereof in an effective amount to reduce plasma leucine, ketoisocaproic acid, and methionine levels. In some embodiments, the engineered leucine decarboxylase is administered to the subject for at least two or more consecutive days. In some embodiments, the engineered leucine decarboxylase is administered to the subject for at least three or more consecutive days. In some embodiments, the engineered leucine decarboxylase is administered to the subject continuously as needed. In some embodiments, the engineered leucine decarboxylase is administered immediately before, concurrently with, and/or immediately following the ingestion of a meal containing protein.

In some embodiments, the subject for treatment with an engineered leucine decarboxylase has maple syrup urine disease, and wherein the symptoms of maple syrup urine disease are ameliorated. In some embodiments, the subject for treatment with an engineered leucine decarboxylase has isovaleric acidemia, and wherein the symptoms of isovaleric acidemia are ameliorated. In some embodiments, the subject for treatment with an engineered leucine decarboxylase has 3-methylcrotonyl-CoA carboxylase deficiency, and wherein the symptoms of 3-methylcrotonyl-CoA carboxylase deficiency are ameliorated. In some embodiments, the subject is able to eat a diet that is less restricted in leucine, isoleucine, and/or valine content compared to diets required by subjects who are afflicted with the disease. In some embodiments, the subject is an infant, child, young adult, or adult. In some embodiments, the subject is an infant. In some embodiments, the subject is a child.

In some embodiments, for the methods and uses described herein, including the methods of treatment or methods of reducing plasma levels of leucine, isoleucine, alloisoleucine and/or ketoisocaproic acid, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to at least one of SEQ ID NO: 2, 4, 6, 8, 10, 12, 14, 38, 234, 284, 484, 594, 686, 688, 766, 828, and/or 888.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to at least one of SEQ ID NO: 2, 4, 6, 8, 10, 12, 14, 38, 234, 284, 484, 594, 686, 688, 766, 828, or 888, wherein the amino acid sequence comprises one or more substitutions relative to the reference sequence corresponding to SEQ ID NO: 2, 4, 6, 8, 10, 12, 14, 38, 234, 284, 484, 594, 686, 688, 766, 828, or 888.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to a reference sequence corresponding to SEQ ID NO: 12, 38, 234, 284, 484, 594, 686, 688, 766, 828, or 888, wherein the amino acid sequence comprises one or more substitutions relative to the reference sequence corresponding to SEQ ID NO: 12, 38, 234, 284, 484, 594, 686, 688, 766, 828, or 888.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to a reference sequence corresponding to SEQ ID NO: 12, 38, 234, 284, 484, 594, 686, 688, 766, 828, or 888, wherein the amino acid sequence comprises one or more substitutions relative to the reference sequence corresponding to SEQ ID NO: 12.

In some embodiments of the methods, the amino acid sequence of the engineered leucine decarboxylase polypeptide comprises at least a substitution at amino acid position 2, 3, 5, 12, 14, 16, 19, 33, 34, 38, 39, 41, 47, 48, 51, 55, 63, 64, 66, 69, 76, 77, 80, 87, 89, 91, 92, 102, 106, 109, 118, 123, 126, 127, 132, 134, 135, 139, 140, 141, 156, 161, 164, 168, 170, 173, 181, 187, 189, 193, 194, 196, 198, 200, 201, 202, 211, 223, 228, 245, 255, 256, 259, 262, 263, 265, 267, 270, 272, 275, 290, 296, 299, 300, 303, 304, 312, 317, 319, 324, 328, 331, 338, 339, 340, 343, 349, 350, 352, 353, 357, 364, 365, 366, 379, 380, 381, 382, 383, 384, 386, 388, 389, 390, 391, 393, 394, 395, 397, 398, 401, 404, or 405, or combinations thereof, wherein the amino acid positions are relative to the reference sequence corresponding to SEQ ID NO: 12.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 12, and wherein the amino acid sequence of the engineered leucine decarboxylase polypeptide comprises at least a substitution or substitution set at amino acid position 5, 14, 14/34/38/39/102/267/275/350/357, 14/39/102/127/245/267/275/349/350, 34/38/39/102/127/275/357, 34/38/39/102/275/357, 34/38/39/127/245/349/350/357, 34/38/39/127/245/350/357, 34/39/102/127/264/275/357, 34/39/102/127/275/349/357, 34/39/102/264/275/350/357, 34/39/275/349/350/357, 38/39/102/127/264/267/350/357, 38/39/102/127/267/275/349/350/357, 38/39/102/127/349/350/357, 38/39/102/127/350, 38/39/102/127/350/357, 38/39/127/245/267/357, 38/39/127/264/275, 38/39/127/264/350/357, 38/39/127/350/357, 38/39/127/357, 38/39/245/275/357, 38/39/264/267/275/350, 38/39/264/275/357, 38/39/275, 38/39/275/350, 39, 39/102/127/264/275/357, 39/102/264/275/357, 39/102/267/275/357, 39/127/245/264/267/275/350, 39/127/245/264/275/350/357, 39/127/245/357, 39/127/267/275/350/357, 39/127/267/350/357, 39/127/357, 39/245/264/267/275/357, 39/264/267/275/350, 39/275/350/357, 48, 139, 164, 196, 255, 299, 318, 324, 339, 343, 350, 353, 357, 364, 365, 379, 381, 386, 389, 391, 393, 394, 395, 397, 398, or 405, wherein the amino acid positions are relative to the reference sequence corresponding to SEQ ID NO: 12.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 38, and wherein the amino acid sequence of the engineered leucine decarboxylase polypeptide comprises at least a substitution or substitution set at amino acid position 48/64/164/324/343/353/357/364, 48/64/164/324/343/364, 48/64/164/353/357/364, 48/64/357/364, 64/164/324/343/353/357/364, 64/164/324/343/357/364, 64/164/353/357, 64/318/324/357/364, 64/324/353/357/364, 132/255/339/379/395, 164/196/324/357/364, 164/318/324/343/353/357, 164/318/324/357/364, 164/324/343/353/357/364, 164/324/357/364, 164/353/357/364, 164/364, 196/318/324/353/357/364, 318/343/357, 324/343/357/364, 324/353/357/364, 324/357/364, 339/379/389/394/395, 339/389/395, 339/391, 339/394/395/405, 357/364, 379/386, 379/394/395/397/404/405, 379/394/395/397/405, 389/394/395/397/405, or 394/397, wherein the amino acid positions are relative to the reference sequence corresponding to SEQ ID NO: 38.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 234, and wherein the amino acid sequence of the engineered leucine decarboxylase polypeptide comprises at least a substitution or substitution set at amino acid position 2, 3, 33, 48/64/255, 48/255/339, 48/255/379, 64, 64/255, 69, 161, 193, 255, 255/318/379, 259, 263, 318/339/379, 324, 324/389/394, 324/389/394/395, 324/389/394/397, 324/394, 324/394/395, 324/394/395/397, 324/395, 339, 340, 380, 382, 389, 389/394, 389/394/395, 389/394/395/397, 389/394/397, 389/395, 389/397, 390, 394, 394/395, 394/395/397, 395, 395/397, 397, 401, or 405, wherein the amino acid positions are relative to the reference sequence corresponding to SEQ ID NO: 234.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 284, and wherein the amino acid sequence of the engineered leucine decarboxylase polypeptide comprises at least a substitution or substitution set at amino acid position 2/64/69/324/380/382/388/ 389, 3/64/69/263/339/380/388, 3/64/69/389, 3/64/69/390, 3/64/379/380/390, 3/69/263/380, 3/69/324, 3/69/324/380/ 382/389/390, 12/135/259/263, 12/135/263/382, 12/259/263/ 304, 48/64/255, 64/69, 64/69/189/259/263/304, 64/69/189/ 259/263/304/339/340/379, 64/69/223/388, 64/69/223/388/ 389/390, 64/69/304/379/382, 64/69/324, 64/69/324/339/ 380/389/390, 64/69/339, 64/69/339/382/388/389, 64/69/ 339/389/390, 64/69/379/380, 64/69/380/388/390, 64/69/ 389, 64/69/390, 64/255/263, 64/263, 64/324/339/389/390, 69/223/263/324/382/388/390, 69/223/324/379/380/382/ 388/390, 69/263, 69/263/324, 69/263/339, 69/263/388, 69/263/389/390, 69/324/379/380/388, 69/324/380, 69/339/ 390, 69/382/390, 259/263/304, 259/263/304/339/340/379, 263/339/389/390, 263/390, or 304/340/379/380/382, wherein the amino acid positions are relative to the reference sequence corresponding to SEQ ID NO: 284.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 484, and wherein the amino acid sequence of the engineered leucine decarboxylase polypeptide comprises at least a substitution or substitution set at amino acid position 3/194/304, 3/259/263/304, 3/259/304, 3/259/304/324/339, 3/259/304/324/382, 3/259/ 304/382, 3/263/304/324, 3/263/304/324/339, 3/263/304/ 324/382, 3/304, 3/304/324, 16, 63, 77, 80, 87/270, 87/270/ 365, 87/328/365, 91, 92, 126, 140, 156, 168/270/328/338, 181, 194, 201, 256, 259, 259/263, 259/263/304, 259/263/ 304/324, 259/263/304/324/382, 259/263/304/379, 259/263/ 304/382, 259/304, 259/304/324, 259/304/324/339, 259/304/ 324/339/382, 259/304/382, 262, 263/304, 263/304/324, 263/ 304/324/339, 263/304/324/382, 263/324, 270, 270/319, 270/ 328/338, 270/328/338/365, 304, 304/324, 324, 328, 352, 365, 366, or 382, wherein the amino acid positions are relative to the reference sequence corresponding to SEQ ID NO: 484.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 594, and wherein the amino acid sequence of the engineered leucine decarboxylase polypeptide comprises at least a substitution or substitution set at amino acid position 16/63/80/126/168/366, 16/63/80/126/181/194/259/324/328/366, 16/63/126/168/ 270/328/366, 16/80/126/324/366, 16/80/126/366, 16/80/ 168, 16/80/168/270/366, 16/80/168/324, 16/80/168/366, 16/80/324, 16/91/126/168/324/366, 16/126/168/366, 16/168/259/366, 16/168/270/324/366, 16/168/324/328/366, 16/168/324/366, 16/168/366, 16/259/263/328, 16/324/328/ 366, 16/328/366, 80/126/168/270/366, 80/126/168/366, 80/126/181/270/324/366, 80/168/270/366, or 168/366, wherein the amino acid positions are relative to the reference sequence corresponding to SEQ ID NO: 594.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 686, and wherein the amino acid sequence of the engineered leucine decarboxylase polypeptide comprises at least a substitution or substitution set at amino acid position 66/76/118/141/201/300, 66/76/198/200/296/303, 66/76/198/200/300, 66/118/200/ 296/303/317, 66/118/296, 66/118/296/300, 66/200, 76/118/ 141/200/296, 76/141/198/200/201/300, 80/201/270, 80/270, 80/270/324, 89/118/200, 106/270/324/352, 118/141/200, 126, 126/201/270/324, 126/270, 141/144/198/200/300, 156/ 270, 156/270/324, 201/270, 201/270/352, 270, or 270/324, wherein the amino acid positions are relative to the reference sequence corresponding to SEQ ID NO: 686.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 686, and wherein the amino acid sequence of the engineered leucine decarboxylase polypeptide comprises at least a substitution or substitution set at amino acid position 19, 109, 123, 134, 170, 173, 187, 211, or 312, wherein the amino acid positions are relative to the reference sequence corresponding to SEQ ID NO: 686.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 688, and wherein the amino acid sequence of the engineered leucine decarboxylase polypeptide comprises at least a substitution or substitution set at amino acid position 19/109/123/141/170/198/ 200/211/270/312, 19/109/123/141/170/198/211, 19/109/ 123/141/170/198/211/270/312, 19/109/123/170/211/270/ 312, 19/109/123/198/200/211/270/312, 19/109/170/173/ 211/270/312, 19/109/211/270/312, 109/170/211/270/312, or 109/211/270/312, wherein the amino acid positions are relative to the reference sequence corresponding to SEQ ID NO: 688.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 766, and wherein the amino acid sequence of the engineered leucine decarboxylase polypeptide comprises at least a substitution or substitution set at amino acid position 5/41, 5/41/228, 33, 41, 47, 51, 55, 64, 126, 265, 267, 270, 331, 353, 357, or 384, wherein the amino acid positions are relative to the reference sequence corresponding to SEQ ID NO: 766.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 766, and wherein the amino acid sequence of the engineered leucine decarboxylase polypeptide comprises at least a substitution or substitution set at amino acid position 66, 66/118, 66/118/296, 66/118/296/300, 66/118/300, 66/296, 66/296/300, 66/300, 118, 118/296, 118/296/300, 118/300, 296, 296/300, or 300, wherein the amino acid positions are relative to the reference sequence corresponding to SEQ ID NO: 766.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99% or more sequence identity to the reference sequence of SEQ ID NO: 828, and wherein the amino acid sequence of the engineered leucine decarboxylase polypeptide comprises at least a substitution or substitution set at amino acid position 170/270/ 383, 270, 41/173, 272, 5/141/272/383, 41/383, 41/141/187/

272/290, 41/141/173/290, 5/272/383, 5/41/173/272/383, 41/141, 141/272, 353/384, 272/383, 41/141/173, 41/272/ 383, 41/141/187/200/202/272, 33/55/64/126/270/357, 33/126/353/357, 55/64/267/35/384, 33/64/357, 126/267, 64/267/353/384, 33/55/64/357, 19/64/126/267, 55/267, 33/126/267/270/312/357, 19/33/55/353/357/384, 19/33/126, 126/312, 126/198/202/267/312, 126/353, 55/126, 126/270/ 384, 33/64/353/357, 19/267, 51/55/267/270/353, 33/126/ 267/270, 19/55/64/126/267/270/353, 19/33/126/270/353/ 357/384, 19/33/64/267/353, 126/353/384, 126/270/312/353/ 384, 19/33/55/126, 33/357, 47/51/64/126/353/384, 126, or 126/270, wherein the amino acid positions are relative to the reference sequence corresponding to SEQ ID NO: 828.

In some embodiments of the methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99% or more sequence identity to the reference sequence of SEQ ID NO: 888, and wherein the amino acid sequence of the engineered leucine decarboxylase polypeptide comprises at least a substitution or substitution set at amino acid position 64/173/ 202/353/384, 41/141/272/353, 141/202/272/353/357, 173/ 202/357, 202/353, 5/51/173/272/353/384, 51/202/272/357, 141/173/272, 272, 41/173/384, 41/64/141/353/357/383, 141/173/202, 5/51/64/202/353, 357, 64, 5/41/141, 41/141/ 173/202/353, 353, 202/357, 51/141/202/272/353, 202, 51/141/173/353/384, 41/141/173/202/272/353/383/384, 64/202/357, 5/64/353/383/384, 41/272/353/383, 41/173/ 272/353/357, 51/141/272/353/357/383/384, 41/353/357, 173/272/353/357, 5/41/64/173/353/357, 64/173/357, 51/272, 51/64/357/384, 51/141/173/272/353, 64/202/272/ 353/357/384, 51/272/357, 51/173/272/353/384, 353/384, 202/272/357, 64/141/173/202/353/357, 5/41/51/202/357/ 383, 5/51/173/272/383, 41/141/272, 51/173, 5/353, 41/64/ 173/272/353/383, 5/64/173/272/353, 51/64, 41/357/383, 41/173/353/357, 202/272/383, 202/272, 353/357, 41/173/ 202/272/357, 141/173/202/272/353/357, 64/141/202, or 5/173/272, wherein the amino acid positions are relative to the reference sequence corresponding to SEQ ID NO: 888.

In some embodiments of the methods, the engineered leucine decarboxylase polypeptide exhibits one or more improved properties as compared to the wild-type Planctomycetaceae species leucine decarboxylase or the engineered leucine decarboxylase having the sequence corresponding to SEQ ID NO: 12. In some embodiments, the improved property is selected from (i) increased activity on leucine, (ii) increased resistance to proteolysis, (iii) increased tolerance to low pH environments, or (iv) increased thermostability, or any combinations thereof, compared to the wild-type Planctomycetaceae species leucine decarboxylase or the leucine decarboxylase having the amino acid sequence corresponding to SEQ ID NO: 12.

In some embodiments of the methods, the engineered leucine decarboxylase comprises at least one leucine decarboxylase polypeptide provided in any of Tables 1-2, 2-1, 3-2, 4-1, 5-1, 6-1, 7-1, 8-1, 8-2, 10-1, 11-1, 11-2, 12-1, and/or 12-2. In some embodiments of the methods, the engineered leucine decarboxylase polypeptide comprises an amino acid sequence comprising an even-numbered SEQ ID NO. of SEQ ID NOS: 2-1064. In some embodiments, the engineered leucine decarboxylase polypeptide comprises an amino acid sequence comprising an even-numbered SEQ ID NO. of SEQ ID NOS: 16-1064.

BRIEF DESCRIPTION OF THE DRAWINGS

FIG. 1A shows the time course of plasma leucine levels in animals treated with Vehicle, LDC polypeptide of SEQ ID NO: 484, LDC polypeptide of SEQ ID NO: 686, or LDC polypeptide of SEQ ID NO: 766. Data is represented as mean±SEM. Multiple t-test compared to vehicle: *, $p<0.05$; , $p<0.01$; *, $p<0.001$; ****, $p<0.0001$. FIG. 1B shows plasma leucine AUC. Data is represented as mean±SEM. One-way ANOVA with Tukey post-test compared to Vehicle: *, $p<0.05$; , $p<0.01$; *, $p<0.001$.

FIG. 2A shows the time course of plasma leucine levels in animals treated with Vehicle or three different doses of LDC of SEQ ID NO: 766. Data is represented as mean±SEM. Multiple t-test compared to vehicle: *, $p<0.05$; , $p<0.01$; *, $p<0.001$; **, $p<0.0001$. FIG. 2B shows plasma leucine AUC. One-way ANOVA compared to Vehicle: , $p<0.01$; , $p<0.001$; *, $p<0.0001$.

FIG. 3A shows plasma leucine time course for treatment with LDC polypeptide of SEQ ID NO: 766 or LDC polypeptide of SEQ ID NO: 828 following a whey protein meal. Data is represented as mean±SEM; Multiple t-tests compared to Vehicle: *, $p<0.05$; , $p<0.01$; *, $p<0.0011$. FIG. 3B shows corresponding plasma leucine AUC; One way ANOVA compared to Vehicle: *, $p<0.05$.

FIG. 4A shows time course of plasma leucine levels following administration of an engineered LDC polypeptide of SEQ ID NO: 484 at three different doses. Data is shown as mean±SEM. Multiple t-tests compared to Vehicle: *, $p<0.05$. FIG. 4B shows time course of plasma leucine levels following administration of LDC polypeptide of SEQ ID NO: 686 at three different doses. Data is shown as mean±SEM. Multiple t-tests compared to Vehicle: *, $p<0.05$. FIG. 4C shows time course of plasma leucine levels following administration of LDC polypeptide of SEQ ID NO: 766 at three different doses. Data is shown as mean±SEM. Multiple t-tests compared to Vehicle: *, $p<0.05$. FIG. 4D show the corresponding plasma leucine AUC for the engineered leucine decarboxylases administered at different doses. Data is shown as mean±SEM. One way ANOVA compared to Vehicle: *, $p<0.05$; , $p<0.01$; *, $p<0.001$.

FIG. 5A shows plasma leucine time course following treatment with three different doses of engineered LDC polypeptide of SEQ ID NO: 766. Data is shown as mean±SEM. Multiple t-tests compared to Vehicle: *, $p<0.05$. FIG. 5B shows corresponding plasma leucine iAUC. Data is shown as mean±SEM. One-Way ANOVA vs Vehicle: *, $p<0.05$; **, $p<0.01$. FIG. 5C show plasma ketoisocaproic acid (KIC) time course for three different doses of the engineered LDC polypeptide of SEQ ID NO: 766. Data is shown as mean±SEM. Multiple t-tests compared to Vehicle: *, p<0.05; , p<0.01. FIG. 5D shows corresponding plasma KIC iAUC for the different doses of the engineered LDC polypeptide of SEQ ID NO: 766. Data is shown as mean±SEM. One-Way ANOVA vs Vehicle: , p<0.01.

FIG. 6A shows plasma leucine time course following treatment with engineered LDC polypeptide of SEQ ID NO: 766. Data is shown as mean±SEM; Multiple t-test *, p<0.05; , p<0.01; *, p<0.001; **, p<0.0001. FIG. 6B** show corresponding plasma leucine AUC. Data is shown as mean±SEM; Unpaired t-test; Vehicle v. Treatment *, p<0.05; , p<0.01.

FIG. 7A shows plasma methionine time course with baseline subtracted following treatment with engineered LDC polypeptide of SEQ ID NO: 766. Data is shown as mean±SEM; Multiple t-test *, p<0.05; , p<0.01; *, p<0.001. FIG. 7B shows corresponding plasma methionine iAUC (baseline subtracted). Data is shown as mean±SEM; Unpaired t-test; Vehicle v. Treatment *, p<0.05; **, p<0.01.

FIG. 8A shows the time course of normalized plasma leucine levels in mice treated with Vehicle and LDC polypeptide of SEQ ID NO: 828 at 25, 50 and 100 mg/kg. Data is represented as mean±SEM. Multiple unpaired t-tests with Welch's correction, compared to vehicle: *p<0.05; p<0.01; *p<0.001; **p<0.0001. FIG. 8B shows plasma leucine iAUC. Data is represented as mean±SEM. One-way ANOVA with Tukey post-test compared to vehicle: p<0.01; ***p<0.001.

FIGS. 9A and 9B show results of a pharmacodynamic (PD) study of the effect of engineered leucine decarboxylase (LDC) in healthy cynomolgus monkeys. Treatment with three doses of engineered LDC (SEQ ID NO: 828) following administration of whey protein meal results in suppression of plasma leucine levels. FIG. 9A shows the time course of normalized plasma leucine levels in monkeys treated with vehicle and LDC polypeptide of SEQ ID NO: 828 at 6.25, 12.5 and 25 mg/kg. Data is represented as mean±SEM. Multiple unpaired t-tests with Welch's correction, compared to vehicle: *p<0.05; p<0.01. FIG. 9B** shows plasma leucine iAUC. Data is represented as mean±SEM. One-way ANOVA with Tukey post-test compared to Vehicle: *p<0.05; ***p<0.001.

FIG. 10A shows the time course of normalized plasma leucine levels in monkeys treated with vehicle and LDC polypeptide of SEQ ID NO: 828 at 3.125, 6.25, 12.5 and 25 mg/kg. Data is represented as mean±SEM. Multiple unpaired t-tests with Welch's correction, compared to vehicle: p<0.01; *p<0.001; **p<0.0001. FIG. 10B** shows plasma leucine iAUC. Data is represented as mean±SEM. One-way ANOVA with Tukey post-test compared to Vehicle: *p<0.05; **p<0.01.

FIG. 11A shows the time course of normalized plasma leucine levels in monkeys treated with vehicle and LDC polypeptide of SEQ ID NO: 828 at 6.25 mg/kg. Data is represented as mean±SEM. Multiple unpaired t-tests with Welch's correction, compared to vehicle. FIG. 11B shows plasma leucine iAUC. Data is represented as mean±SEM. One-way ANOVA with Tukey post-test compared to Vehicle: *p<0.05; , p<0.01. FIG. 11C** shows plasma KIC iAUC. Data is represented as mean±SEM. One-way ANOVA with Tukey post-test compared to Vehicle: *p<0.05.

DESCRIPTION OF THE INVENTION

Figure 1A:
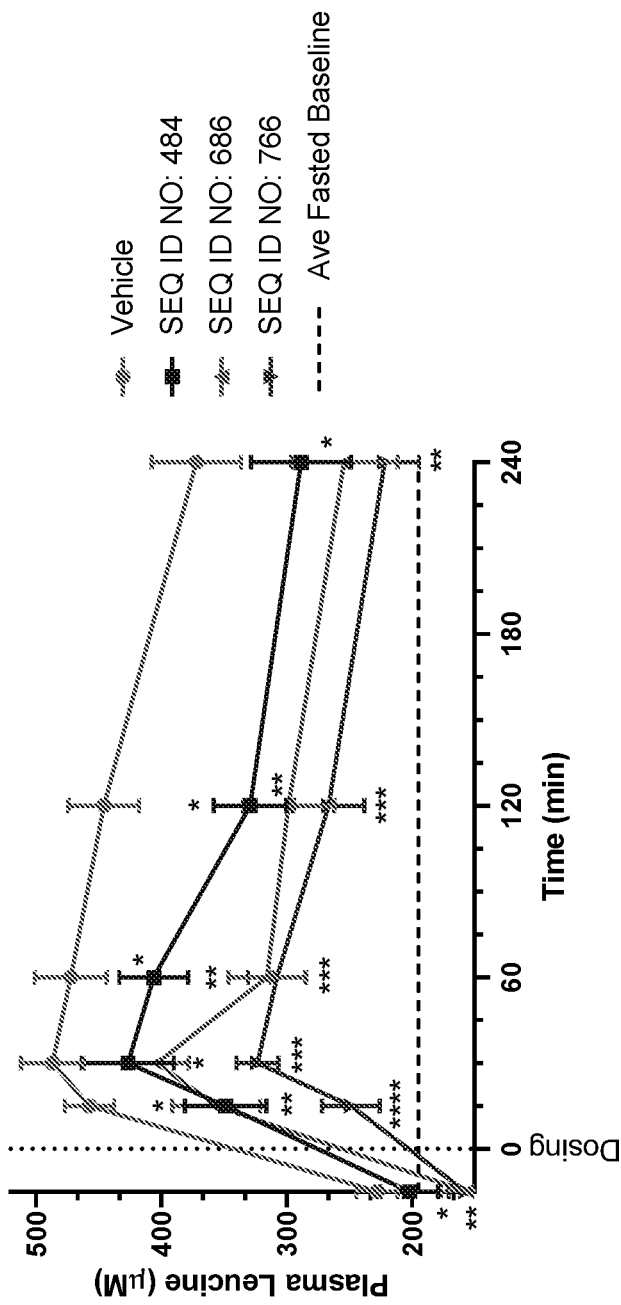
FIGS. 1A and 1B show results of a pharmacodynamic (PD) study of the effect of engineered leucine decarboxy-lases in an intermediate MSUD mouse model. Treatment with engineered leucine decarboxylases following administration of whey protein meal results in suppression of plasma leucine levels.

The present disclosure provides engineered leucine decarboxylase (LDC) polypeptides and compositions thereof, as well as polynucleotides encoding the engineered leucine decarboxylase polypeptides. In some embodiments, the engineered leucine decarboxylase polypeptides are engineered to provide enhanced catalytic activity, as well as reduced sensitivity to proteolysis, increased tolerance to low pH environments, and/or increased thermostability. In some embodiments, the engineered leucine decarboxylase polypeptides are evolved to provide improved storage stability. The present disclosure also provides methods for the use of the engineered leucine decarboxylase polypeptides and compositions thereof for therapeutic and industrial purposes.

Abbreviations and Definitions

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

Also, as used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

The term "about" means an acceptable error for a particular value. In some instances, "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

As used herein, the term "leucine decarboxylase polypeptide" or "LDC" refers to a member of the valine decarboxylase enzyme class (EC 4.1.1.14). These enzymes use a pyridoxal 5'-phosphate (PLP) cofactor to decarboxylate amino acids such as valine and leucine, resulting in 2-methylpropanamine and isopentylamine, respectively, while releasing carbon dioxide.

"Protein," "polypeptide," and "peptide" are used interchangeably herein to denote a polymer of at least two amino acids covalently linked by an amide bond, regardless of length or post-translational modification (e.g., glycosylation or phosphorylation).

"Polynucleotide" is used herein to denote a polymer comprising at least two nucleotides where the nucleotides are either deoxyribonucleotides or ribonucleotides.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes, as indicated The abbreviations used for the genetically encoded amino acids are conventional and are as follows: alanine (Ala or A), arginine (Arg or R), asparagine (Asn or N), aspartate (Asp or D), cysteine (Cys or C), glutamate (Glu or E), glutamine (Gln or Q), glycine (Gly or G), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V).

The term "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques. In some embodiments, "recombinant LDC polypeptides" (also referred to herein as "engineered LDC polypeptides," "variant LDC enzymes," and "LDC variants") are leucine decarboxylases made using recombinant techniques.

As used herein, "wild-type" and "naturally-occurring" refer to the form found in nature. For example, a wild-type polypeptide or polynucleotide sequence is a sequence present in an organism that can be isolated from a source in nature and which has not been intentionally modified by human manipulation.

"Coding sequence" refers to that part of a nucleic acid (e.g., a gene) that encodes an amino acid sequence of a protein.

The term "percent (%) sequence identity" is used herein to refer to comparisons among polynucleotides and polypeptides, and are determined by comparing two optimally aligned sequences over a comparison window, wherein the portion of the polynucleotide or amino acid sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted (e.g., by the local homology algorithm of Smith and Waterman; Smith and Waterman, Adv. Appl. Math., 1981, 2:482), by the homology alignment algorithm of Needleman and Wunsch (Needleman and Wunsch, J. Mol. Biol., 1970, 48:443), by the search for similarity method of Pearson and Lipman (Pearson and Lipman, Proc. Natl. Acad. Sci. USA, 1988, 85:2444), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms (See e.g., Altschul et al., J. Mol. Biol., 1990, 215: 403-410; and Altschul et al., Nucleic Acids Res., 1977, 3389-3402). Software for performing BLAST analyses is publicly available through the National Center for Biotechnology Information website. This algorithm involves first identifying high scoring sequence pairs (HSPs) by identifying short words of length "W" in the query sequence, which either match or satisfy some positive-valued threshold score "T," when aligned with a word of the same length in a database sequence. T is referred to as the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters "M" (reward score for a pair of matching residues; always >0) and "N" (penalty score for mismatching residues; always <0). For amino acid sequences, a scoring matrix is used to calculate the cumulative score. Extension of the word hits in each direction are halted when: the cumulative alignment score falls off by the quantity "X" from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See e.g., Henikoff and Henikoff, Proc. Natl. Acad. Sci. USA, 1989, 89:10915). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence comparison. A reference sequence may be a subset of a larger sequence, for example, a segment of a full-length gene or amino acid sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, the phrase "reference sequence based on SEQ ID NO: 686 having a valine at the residue corresponding to "X123" refers to a reference sequence in which the corresponding residue at position X123 in SEQ ID NO: 686 (e.g., a tyrosine), has been changed to valine.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered leucine decarboxylase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" and "residue difference" refer to a difference in the amino acid residue at a position of an amino acid sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X123 as compared to SEQ ID NO:686" refers to a difference of the amino acid residue at the polypeptide position corresponding to position 123 of SEQ ID NO: 686. Thus, if the reference polypeptide of SEQ ID NO: 686 has a tyrosine at position 123, then a "residue difference at position X123 as compared to SEQ ID NO:686" refers to an amino acid substitution of any residue other than tyrosine at the position of the polypeptide corresponding to position 123 of SEQ ID NO: 686. In most instances herein, the specific amino acid residue difference at a position is indicated as "XnY" where "Xn" specified the corresponding residue and position of the reference polypeptide (as described above), and "Y" is the single letter identifier of the amino acid found in the engineered polypeptide (i.e., the different residue than in the reference polypeptide). In some instances, the original amino acid is not indicated (e.g., 123F). In some instances (e.g., in Tables 1-2, 2-1, 3-2, 4-1, 5-1, 6-1, 7-1, 8-1, 8-2, 10-1, 11-1, 11-2, 12-1, and 12-2), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X123F/X123M/X123V or X123F/M/V or 123F/M/V). The present disclosure includes engineered polypeptide sequences comprising one or more amino acid differences that include either/or both conservative and non-conservative amino acid substitutions.

The terms "amino acid substitution set" and "substitution set" refers to a group of amino acid substitutions within an amino acid sequence. In some embodiments, substitution sets comprise 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant leucine decarboxylase polypeptides listed in any of the Tables in the Examples and Appendix (i.e., Tables 1-2, 2-1, 3-2, 4-1, 5-1, 6-1, 7-1, 8-1, 8-2, 10-1, 11-1, 11-2, 12-1, and 12-1).

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acid having aromatic side chains is substituted with another amino acid having an aromatic side chain (e.g., phenylalanine, tyrosine, tryptophan, and histidine); an amino acid with a basic side chain is substituted with another amino acid with a basic side chain (e.g., lysine and arginine); an amino acid with an acidic side chain is substituted with another amino acid with an acidic side chain (e.g., aspartic acid or glutamic acid); and a hydrophobic or hydrophilic amino acid is replaced with another hydrophobic or hydrophilic amino acid, respectively. Exemplary conservative substitutions include the substitution of A, L, V, or I with other aliphatic residues (e.g., A, L, V, I) or other non-polar residues (e.g., A, L, V, I, G, M); substitution of G or M with other non-polar residues (e.g., A, L, V, I, G, M); substitution of D or E with other acidic residues (e.g., D, E); substitution of K or R with other basic residues (e.g., K, R); substitution of N, Q, S, or T with other polar residues (e.g., N, Q, S, T); substitution of H, Y, W, or F with other aromatic residues (e.g., H, Y, W, F); or substitution of C or P with other non-polar residues (e.g., C, P).

"Non-conservative substitution" refers to substitution of an amino acid in the polypeptide with an amino acid with significantly differing side chain properties. Non-conservative substitutions may use amino acids between, rather than within, the defined groups and affect: (a) the structure of the peptide backbone in the area of the substitution (e.g., proline for glycine); (b) the charge or hydrophobicity; and/or (c) the bulk of the side chain. By way of example and not limitation, exemplary non-conservative substitutions include an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered leucine decarboxylase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

The terms "functional fragment" and "biologically active fragment" are used interchangeably herein, to refer to a polypeptide that has an amino-terminal and/or carboxy-terminal deletion(s) and/or internal deletions, but where the remaining amino acid sequence is identical to the corresponding positions in the sequence to which it is being compared (e.g., a full length engineered LDC of the present invention) and that retains substantially all of the activity of the full-length polypeptide. In some embodiments, substantially all of the activity of the full-length polypeptide refers to at least 90% activity of the recombinant polypeptide from which it was derived.

"Isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., host cell or in vitro synthesis). The recombinant leucine decarboxylase polypeptides may be present within a cell, present in the cellular medium, or prepared in various forms, such as lysates or isolated preparations. As such, in some embodiments, the recombinant leucine decarboxylase polypeptides provided herein are isolated polypeptides.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure leucine decarboxylase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant leucine decarboxylase polypeptides are substantially pure polypeptide compositions.

"Improved enzyme property" in the context of an engineered leucine decarboxylase polypeptide refers to improvement in any enzyme property as compared to a reference leucine decarboxylase polypeptide, such as a wild-type leucine decarboxylase polypeptide (e.g., wild-type LDC having SEQ ID NO: 2) or another engineered leucine decarboxylase polypeptide. Improved properties include but are not limited to such properties as increased protein production, increased serum stability, increased serum half-life in vivo, increased thermoactivity, increased thermostability, increased pH activity, increased stability, increased enzymatic activity, increased substrate specificity and/or affinity, increased specific activity, increased resistance to substrate and/or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, reduced immunogenicity (i.e., reduced capability of inducing and/or eliciting an immune response), and altered temperature profile.

"Increased enzymatic activity" and "enhanced catalytic activity" refer to an improved property of the engineered leucine decarboxylase polypeptides, which can be represented by an increase in specific activity (e.g., product produced/time/weight protein) and/or an increase in percent conversion of the substrate to the product (e.g., percent conversion of starting amount of substrate to product in a specified time period using a specified amount of leucine decarboxylase) as compared to the reference leucine decarboxylase enzyme (e.g., wild-type leucine decarboxylase and/or another engineered leucine decarboxylase). Exemplary methods to determine enzyme activity are provided in the Examples. Any property relating to enzyme activity may be affected, including the classical enzyme properties of Km, Vmax or kcat, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring leucine decarboxylase or another engineered leucine decarboxylase from which the leucine decarboxylase polypeptides were derived.

In some embodiments, the engineered leucine decarboxylase polypeptides have a specific activity of at least 0.01 µmol/min-mg, at least 0.02/µmol/min-mg, at least 0.03/µmol/min-mg, at least 0.05/µmol/min-mg, at least 1.0/µmol/min-mg, and in some preferred embodiments greater than 2.0/µmol/min-mg. In some embodiments, the Km is in the range of about 1 µm to about 5 mM; in the range of about 5 µm to about 2 mM; in the range of about 10 µm to about 2 mM; or in the range of about 10 µm to about 1 mM. In some specific embodiments, the engineered leucine decarboxylase enzyme exhibits improved enzymatic activity in the range of 1.5 to 10 fold, 1.5 to 25 fold, 1.5 to 50 fold, 1.5 to 100 fold or greater, than that of the reference leucine decarboxylase enzyme. Leucine decarboxylase activity can be measured by any standard assay known in the art (e.g., by monitoring depletion of reactants or formation of products). In some embodiments, the amount of products produced or the amount of substrate consumed is measured by High-Performance Liquid Chromatography (HPLC) separation combined with UV absorbance or mass spectra detection. In some embodiments, comparisons of enzyme activities are made using a defined preparation of enzyme, a defined assay under a set condition, and one or more defined substrates, as further described in detail herein. Generally, when lysates are compared, the number of cells and the amount of protein assayed are determined as well as use of identical expression systems and identical host cells, in order to minimize variations in amount of enzyme produced by the host cells and present in the lysates.

The phrase "increased storage stability" means that an engineered leucine decarboxylase polypeptide according to the invention will retain more activity compared to a reference leucine decarboxylase in a standard assay (e.g., as described in the Examples) after it has been produced in a dried form (e.g., by lyophilization or spray-drying), and stored for a period of time ranging from a few days to multiple months at a temperature above room temperature (e.g., 30° C., 37° C., 45° C., 55° C., etc.).

"Conversion" refers to the enzymatic conversion (or biotransformation) of substrate(s) to the corresponding product(s). "Percent conversion" refers to the percent of the substrate that is converted to the product within a period of time under specified conditions. Thus, the "enzymatic activity" or "activity" of a leucine decarboxylase polypeptide can be expressed as "percent conversion" of the substrate to the product in a specific period of time.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature Tm as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above. In some embodiments, a polynucleotide encoding a leucine decarboxylase hybridizes under high stringency conditions to an recombinant polynucleotide disclosed herein encoding an engineered decarboxylase polypeptide.

"Codon optimized" refers to changes in the codons of the polynucleotide encoding a protein to those preferentially used in a particular organism such that the encoded protein is more efficiently expressed in that organism. Although the genetic code is degenerate, in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the leucine decarboxylase enzymes are codon optimized for optimal production from the host organism selected for expression. "Control sequence" refers herein to include all components that are necessary or advantageous for the expression of a polynucleotide and/or polypeptide of the present disclosure. Each control sequence may be native or foreign to the nucleic acid sequence encoding the polypeptide. Such control sequences include, but are not limited to, leaders, polyadenylation sequences, propeptide sequences, promoter sequences, signal peptide sequences, initiation sequences, and transcription terminators. At a minimum, the control sequences include a promoter, and transcriptional and translational stop signals. In some embodiments, the control sequences are provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide encoding a polypeptide of interest.

"Promoter sequence" refers to a nucleic acid sequence that is recognized by a host cell for expression of a polynucleotide of interest, such as a coding sequence. The promoter sequence contains transcriptional control sequences that mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Substrate" in the context of an enzymatic conversion reaction process refers to the compound or molecule acted on by the leucine decarboxylase polypeptide. "Product" in the context of an enzymatic conversion process refers to the compound or molecule resulting from the action of the leucine decarboxylase polypeptide on the substrate.

As used herein the term "culturing" refers to the growing of a population of cells under suitable conditions using any suitable medium (e.g., liquid, gel, or solid).

Recombinant polypeptides (e.g., LDC enzyme variants) can be produced using any suitable methods known in the art. For example, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.).

As used herein, the phrase "suitable reaction conditions" refers to those conditions in the enzymatic conversion reaction solution (e.g., ranges of enzyme loading, substrate loading, temperature, pH, buffers, co-solvents, etc.) under which a leucine decarboxylase polypeptide of the present application is capable of converting a substrate to the desired product compound. Exemplary "suitable reaction conditions" are provided in the present application and illustrated by the Examples. "Loading", such as in "compound loading" or "enzyme loading" refers to the concentration or amount of a component in a reaction mixture at the start of the reaction. "Substrate" in the context of an enzymatic conversion reaction process refers to the compound or molecule acted on by the leucine decarboxylase polypeptide. "Product" in the context of an enzymatic conversion process refers to the compound or molecule resulting from the action of the leucine decarboxylase polypeptide on a substrate.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., a polynucleotide sequences encoding at least one LDC variant). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues refer to non-naturally occurring amino acid residues including, but not limited to, homoarginine, ornithine and norvaline, as well as naturally occurring amino acids. In some embodiments, analogues also include one or more D-amino acid residues and non-peptide linkages between two or more amino acid residues.

The term "therapeutic" refers to a compound administered to a subject who shows signs or symptoms of pathology having beneficial or desirable medical effects.

The term "pharmaceutical composition" refers to a composition suitable for pharmaceutical use in a mammalian subject (e.g., human) comprising a pharmaceutically effective amount of an engineered leucine decarboxylase polypeptide encompassed by the invention and an acceptable carrier.

The term "gene therapy" is used in reference to the use of genes (i.e., genetic material) to treat and/or prevent disease in a mammalian subject (e.g., human). In some embodiments, the genetic material is introduced directly into at least some cells of the mammalian subject. It is not intended that the present invention be limited to any specific method(s) or composition(s) useful for gene therapy.

The term "mRNA therapy" is used in reference to the use of messenger RNA (mRNA) to treat and/or prevent disease in a mammalian subject (e.g., human). In some embodiments, the genetic material is introduced directly into at least some cells of the mammalian subject. It is not intended that the present invention be limited to any specific method(s) or composition(s) useful for mRNA therapy.

The term "effective amount" means an amount sufficient to produce the desired result. One of general skill in the art may determine what the effective amount in view of the guidance in the specification.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

The term "subject" encompasses mammals such as humans, non-human primates, livestock, companion animals, and laboratory animals (e.g., rodents and lagomorphs). It is intended that the term encompass females as well as males.

As used herein, the term "patient" means any subject that is being assessed for, treated for, or is experiencing disease.

The term "infant" refers to a child in the period of the first month after birth to approximately one (1) year of age. As used herein, the term "newborn" refers to child in the period from birth to the 28th day of life. The term "premature infant" refers to an infant born after the twentieth completed week of gestation, yet before full term, generally weighing ~500 to –2499 grams at birth. A "very low birth weight infant" is an infant weighing less than 1500 g at birth.

As used herein, the term "child" refers to a person who has not attained the legal age for consent to treatment or research procedures. In some embodiments, the term refers to a person between the time of birth and adolescence.

As used herein, the term "adult" refers to a person who has attained legal age for the relevant jurisdiction (e.g., 18 years of age in the United States). In some embodiments, the term refers to any fully grown, mature organism. In some embodiments, the term "young adult" refers to a person less than 18 years of age, but who has reached sexual maturity.

As used herein, "composition" and "formulation" encompass products comprising at least one engineered leucine decarboxylase of the present invention, intended for any suitable use (e.g., pharmaceutical compositions, dietary/nutritional supplements, feed, etc.).

The terms "administration" and "administering" a composition mean providing a composition of the present invention to a subject (e.g., to a person suffering from the effects of MSUD).

The term "carrier" when used in reference to a pharmaceutical composition means any of the standard pharmaceutical carrier, buffers, and excipients, such as stabilizers, preservatives, and adjuvants.

The term "pharmaceutically acceptable" means a material that can be administered to a subject without causing any undesirable biological effects or interacting in a deleterious manner with any of the components in which it is contained and that possesses the desired biological activity.

As used herein, the term "excipient" refers to any pharmaceutically acceptable additive, carrier, diluent, adjuvant, or other ingredient, other than the active pharmaceutical ingredient (API; e.g., the engineered leucine decarboxylase polypeptides of the present invention). Excipients are typically included for formulation and/or administration purposes.

The term "therapeutically effective amount" when used in reference to symptoms of disease/condition refers to the amount and/or concentration of a compound (e.g., engineered LDC polypeptides) that ameliorates, attenuates, or eliminates one or more symptom of a disease/condition or prevents or delays the onset of symptom(s) (e.g., MSUD). In some embodiments, the term is use in reference to the amount of a composition that elicits the biological (e.g., medical) response by a tissue, system, or animal subject that is sought by the researcher, physician, veterinarian, or other clinician.

The term "therapeutically effective amount" when used in reference to a disease/condition refers to the amount and/or concentration of a composition that ameliorates, attenuates, or eliminates the disease/condition.

It is intended that the terms "treating," "treat" and "treatment" encompass preventative (e.g., prophylactic), as well as palliative treatment.

As used herein, the term "at least one" is not intended to limit the invention to any particular number of items. It is intended to encompass one, two, three, four, five, six, seven, eight, nine, ten, or more items, as desired.

Engineered IDC Polypeptides

The present disclosure provides engineered leucine decarboxylases (LDC) and their use as a pharmaceutical, nutraceutical, and/or industrial applications. In the present disclosure, when a particular leucine decarboxylase variant (i.e., an engineered LDC polypeptide) is referred to by reference to modification of particular amino acids residues in the sequence of a wild-type leucine decarboxylase or reference leucine decarboxylase it is to be understood that variants of another leucine decarboxylase modified in the equivalent position(s) (as determined from an amino acid sequence alignment between the respective amino acid sequences) are encompassed herein.

In some embodiments, the parent leucine decarboxylase polypeptides from which the engineered leucine decarboxylase polypeptides of the invention are derived from include bacterial strains such as those in the Planctomycetaceae family bacteria. Leucine decarboxylase from different sources and applicable to the uses herein are provided in Table 1-2.

In some embodiments, the engineered leucine decarboxylase polypeptides are produced by cultivating cells or microorganisms comprising at least one polynucleotide sequence encoding at least one engineered leucine decarboxylase polypeptide under conditions which are conducive for producing the engineered leucine decarboxylase polypeptide. In some embodiments, the engineered leucine decarboxylase polypeptide is subsequently recovered from the resulting culture medium and/or cells.

In some embodiments, the engineered leucine decarboxylase polypeptides of the present disclosure comprise amino acid sequences having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence of SEQ ID NO: 828 or 888, wherein the amino acid sequence comprises one or more substitutions in its amino acid sequence.

In some embodiments, the engineered leucine decarboxylase polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to the reference sequence corresponding to SEQ ID NO: 828, wherein the amino acid sequence comprises one or more substitutions relative to the reference sequence corresponding to SEQ ID NO: 828.

In some embodiments, the engineered leucine decarboxylase polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to the reference sequence corresponding to SEQ ID NO: 888, wherein the amino acid sequence comprises one or more substitutions relative to the reference sequence corresponding to SEQ ID NO: 828.

In some embodiments, the amino acid sequence of the engineered leucine decarboxylase polypeptide comprises at least a substitution at amino acid position 5, 19, 33, 41, 47, 51, 55, 64, 141, 170, 173, 187, 198, 200, 202, 267, 270, 272, 290, 312, 353, 357, 383, or 384, or combinations thereof, wherein the amino acid positions are relative to the reference sequence corresponding to SEQ ID NO: 828.

In some embodiments, the amino acid sequence of the engineered leucine decarboxylase polypeptide comprises at least a substitution 5V, 19L, 33L, 41D, 47F, 51E, 55I, 64S/N, 141P, 170P, 173I, 187L, 198G, 200S, 202H, 267L, 270L/T, 272A, 290I, 312T, 353E, 357S/C, 383S, or 384W, or combinations thereof, wherein the amino acid positions are relative to the reference sequence corresponding to SEQ ID NO: 828.

In some embodiments, the amino acid sequence of the engineered leucine decarboxylase polypeptide comprises at least a substitution at position 33, 55, 64, 126, 270, or 357, or combinations thereof, wherein the amino acid positions are relative to the reference sequence corresponding to SEQ ID NO: 828.

In some embodiments, the amino acid sequence of the engineered leucine decarboxylase polypeptide comprises at least a substitution 33L, 55I, 64N, 126A, 270L, or 357S, or combinations thereof, wherein the amino acid positions are relative to the reference sequence corresponding to SEQ ID NO: 828.

In some embodiments, the amino acid sequence of the engineered leucine decarboxylase polypeptide comprises at least a substitution at position 33, 55, 64, 126, 270, and 357, or combinations thereof, wherein the amino acid positions are relative to the reference sequence corresponding to SEQ ID NO: 828.

In some embodiments, the amino acid sequence of the engineered leucine decarboxylase polypeptide comprises at least a substitution 33L, 55I, 64N, 126A, 270L, and 357S, or combinations thereof, wherein the amino acid positions are relative to the reference sequence corresponding to SEQ ID NO: 828.

In some embodiments, the amino acid sequence of the engineered leucine decarboxylase polypeptide comprises at least a substitution or substitution set at amino acid position 170/270/383, 270, 41/173, 272, 5/141/272/383, 41/383, 41/141/187/272/290, 41/141/173/290, 5/272/383, 5/41/173/272/383, 41/141, 141/272, 353/384, 272/383, 41/141/173, 41/272/383, 41/141/187/200/202/272, 33/55/64/126/270/357, 33/126/353/357, 55/64/267/35/384, 33/64/357, 126/267, 64/267/353/384, 33/55/64/357, 19/64/126/267, 55/267, 33/126/267/270/312/357, 19/33/55/353/357/384, 19/33/126, 126/312, 126/198/202/267/312, 126/353, 55/126, 126/270/384, 33/64/353/357, 19/267, 51/55/267/270/353, 33/126/267/270, 19/55/64/126/267/270/353, 19/33/126/270/353/357/384, 19/33/64/267/353, 126/353/384, 126/270/312/353/384, 19/33/55/126, 33/357, 47/51/64/126/353/384, 126, or 126/270, wherein the amino acid positions are relative to the reference sequence corresponding to SEQ ID NO: 828.

In some embodiments, the amino acid sequence of the engineered leucine decarboxylase polypeptide comprises at least a substitution or substitution set 170P/270L/383S, 270L, 41D/173I, 272A, 5V/141P/272A/383S, 41D/383S, 41D/141P/187L/272A/290I, 41D/141P/173I/290I, 5V/272A/383S, 5V/41D/173I/272A/383S, 41D/141P, 141P/272A, 353E/384W, 272A/383S, 41D/141P/173I, 41D/272A/383S, 41D/141P/187L/200S/202H/272A, 33L/55I/64N/126A/270L/357S, 33L/126A/353E/357S, 55I/64N/267L/353E/384W, 33L/64N/357S, 126A/267L, 64N/267L/353E/384W, 33L/55I/64N/357S, 19L/64N/126A/267L, 55I/267L, 33L/126A/267L/270T/312T/357S, 19L/33L/55I/353E/357S/384W, 19L/33L/126A, 126A/312T, 126A/198G/202H/267L/312T, 126A/353E, 55I/126A, 126A/270T/384W, 33L/64N/353E/357S, 19L/267L, 51E/55I/267L/270T/353E, 33L/126A/267L/270T, 19L/55I/64N/126A/267L/270T/353E, 19L/33L/126A/270T/353E/357S/384W, 19L/33L/64N/267L/353E, 126A/353E/384W, 126A/270T/312T/353E/384W, 19L/33L/55I/126A, 33L/357S, 47F/51E/64N/126A/353E/384W, 126A, or 126A/270T, wherein the amino acid positions are relative to the reference sequence corresponding to SEQ ID NO: 828.

In some embodiments, the amino acid sequence of the engineered leucine decarboxylase polypeptide comprises at least a substitution or substitution set A170P/R270L/A383S, R270L, H41D/F173I, T272A, K5V/R141P/T272A/A383S, H41D/A383S, H41D/R141P/V187L/T272A/V290I, H41D/R141P/F173I/V290I, K5V/T272A/A383S, K5V/H41D/F173I/T272A/A383S, H41D/R141P, R141P/T272A, D353E/P384W, T272A/A383S, H41D/R141P/F173I, H41D/T272A/A383S, H41D/R141P/V187L/H200S/S202H/T272A, F33L/V55I/S64N/D126A/R270L/C357S, F33L/D126A/D353E/C357S, V55I/S64N/I267L/D353E/P384W, F33L/S64N/C357S D126A/I267L, S64N/I267L/D353E/P384W, F33L/V55I/S64N/C357S, I19L/S64N/D126A/I267L, V55I/I267L, F33L/D126A/I267L/R270T/A312T/C357S, I19L/F33L/V55I/D353E/C357S/P384W, I19L/F33L/D126A, D126A/A312T, D126A/A198G/S202H/I267L/A312T, D126A/D353E, V55I/D126A, D126A/R270T/P384W F33L/S64N/D353E/C357S, I19L/I267L, L51E/V55I/I267L/R270T/D353E, F33L/D126A/I267L/R270T, I19L/V55I/S64N/D126A/I267L/R270T/D353E, I19L/F33L/D126A/R270T/D353E/C357S/P384W, I19L/F33L/S64N/I267L/D353E, D126A/D353E/P384W, D126A/R270T/A312T/D353E/P384W, I19L/F33L/V55I/D126A, F33L/C357S, L47F/L51E/S64N/D126A/D353E/P384W, D126A, or D126A/R270T, wherein the amino acid positions are relative to the reference sequence corresponding to SEQ ID NO: 828.

In some embodiments, the engineered leucine decarboxylase comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or more sequence identity to SEQ ID NO: 888, wherein the amino acid sequence comprises one or more substitutions relative to the reference sequence corresponding to SEQ ID NO: 888.

In some embodiments, the amino acid sequence of the engineered leucine decarboxylase polypeptide comprises at least a substitution at amino acid position 5, 19, 33, 41, 47, 51, 55, 64, 141, 170, 173, 187, 198, 200, 202, 267, 270, 272, 290, 312, 353, 357, 383, or 384, or combinations thereof, wherein the amino acid positions are relative to the reference sequence corresponding to SEQ ID NO: 888.

In some embodiments, the amino acid sequence of the engineered leucine decarboxylase polypeptide comprises amino acid residue 5V, 19L, 33L, 41D, 47F, 51E, 55I, 64S/N, 141P, 170P, 173I, 187L, 198G, 200S, 202H, 267L, 270L/T, 272A, 290I, 312T, 353E, 357S/C, 383S, or 384W, or combinations thereof, wherein the amino acid positions are relative to the reference sequence corresponding to SEQ ID NO: 888.

In some embodiments, the amino acid sequence of the engineered leucine decarboxylase polypeptide comprises at least a substitution or substitution set at amino acid position: 64/173/202/353/384, 41/141/272/353, 141/202/272/353/357, 173/202/357, 202/353, 5/51/173/272/353/384, 51/202/272/357, 141/173/272, 272, 41/173/384, 41/64/141/353/357/383, 141/173/202, 5/51/64/202/353, 357, 64, 5/41/141, 41/141/173/202/353, 353, 202/357, 51/141/202/272/353, 202, 51/141/173/353/384, 41/141/173/202/272/353/383/384, 64/202/357, 5/64/353/383/384, 41/272/353/383, 41/173/272/353/357, 51/141/272/353/357/383/384, 41/353/357, 173/272/353/357, 5/41/64/173/353/357, 64/173/357, 51/272, 51/64/357/384, 51/141/173/272/353, 64/202/272/353/357/384, 51/272/357, 51/173/272/353/384, 353/384, 202/272/357, 64/141/173/202/353/357, 5/41/51/202/357/383, 5/51/173/272/383, 41/141/272, 51/173, 5/353, 41/64/173/272/353/383, 5/64/173/272/353, 51/64, 41/357/383, 41/173/353/357, 202/272/383, 202/272, 353/357, 41/173/202/272/357, 141/173/202/272/353/357, 64/141/202, or 5/173/272, wherein the amino acid positions are relative to the reference sequence corresponding to SEQ ID NO: 888.

In some embodiments, the amino acid sequence of the engineered leucine decarboxylase polypeptide comprises at least a substitution or substitution set 64S/173I/202H/353E/384W, 41D/141P/272A/353E, 141P/202H/272A/353E/357C, 173I/202H/357C, 202H/353E, 5V/51E/173I/272A/353E/384W, 51E/202H/272A/357C, 141P/173I/272A, 272A, 41D/173I/384W, 41D/64S/141P/353E/357C/383S, 141P/173I/202H, 5V/51E/64S/202H/353E, 357C, 64S, 5V/41D/141P, 41D/141P/173I/202H/353E, 353E, 202H/357C, 51E/141P/202H/272A/353E, 202H, 51E/141P/173I/353E/384W, 41D/141P/173I/202H/272A/353E/383S/384W, 64S/202H/357C, 5V/64S/353E/383S/384W, 41D/272A/353E/383S, 41D/173I/272A/353E/357C, 51E/141P/272A/353E/357C/383S/384W, 41D/353E/357C, 173I/272A/353E/357C, 5V/41D/64S/173I/353E/357C, 64S/173I/357C, 51E/272A, 51E/64S/357C/384W, 51E/141P/173I/272A/353E, 64S/202H/272A/353E/357C/384W, 51E/272A/357C, 51E/173I/272A/353E/384W, 353E/384W, 202H/272A/357C, 64S/141P/173I/202H/353E/357C, 5V/141P/51E/202H/357C/383S, 5V/51E/173I/272A/383S, 41D/141P/272A, 51E/173I, 5V/353E, 41D/64S/173I/272A/353E/383S, 5V/64S/173I/272A/353E, 51E/64S, 41D/357C/383S, 41D/173I/353E/357C, 202H/272A/383S, 202H/272A, 353E/357C, 41D/173I/202H/272A/357C, 141P/173I/202H/272A/353E/357C, 64S/141P/202H, 5V/173I/272A, wherein the amino acid positions are relative to the reference sequence corresponding to SEQ ID NO: 888.

In some embodiments, the amino acid sequence of the engineered leucine decarboxylase polypeptide comprises at least a substitution or substitution set N64S/F173I/S202H/D353E/P384W, H41D/R141P/T272A/D353E, R141P/S202H/T272A/D353E/S357C, F173I/S202H/S357C, S202H/D353E, K5V/L51E/F173I/T272A/D353E/P384W, L51E/S202H/T272A/S357C, R141P/F173I/T272A, T272A, H41D/F173I/P384W, H41D/N64S/R141P/D353E/S357C/A383S, R141P/F173I/S202H, K5V/L51E/N64S/S202H/D353E, S357C, N64S, K5V/H41D/R141P, H41D/R141P/F173I/S202H/D353E, D353E, S202H/S357C, L51E/R141P/S202H/T272A/D353E, S202H, L51E/R141P/F173I/D353E/P384W, H41D/R141P/F173I/S202H/T272A/D353E/A383S/P384W, N64S/S202H/S357C, K5V/N64S/D353E/A383S/P384W, H41D/T272A/D353E/A383S, H41D/F173I/T272A/D353E/S357C, L51E/R141P/T272A/D353E/S357C/A383S/P384W, H41D/D353E/S357C, F173I/T272A/D353E/S357C, K5V/H41D/N64S/F173I/D353E/S357C, N64S/F173I/S357C, L51E/T272A, L51E/N64S/S357C/P384W, L51E/R141P/F173I/T272A/D353E, N64S/S202H/T272A/D353E/S357C/P384W, L51E/T272A/S357C, L51E/F173I/T272A/D353E/P384W, D353E/P384W, S202H/T272A/S357C, N64S/R141P/F173I/S202H/D353E/S357C, K5V/H41D/L51E/S202H/S357C/A383S, K5V/L51E/F173I/T272A/A383S, H41D/R141P/T272A, L51E/F173I, K5V/D353E, H41D/N64S/F173I/T272A/D353E/A383S, K5V/N64S/F173I/T272A/D353E, L51E/N64S, H41D/S357C/A383S, H41D/F173I/D353E/S357C, S202H/T272A/A383S, S202H/T272A, D353E/S357C, H41D/F173I/S202H/T272A/S357C, R141P/F173I/S202H/T272A/D353E/S357C, N64S/R141P/S202H, K5V/F173I/T272A, wherein the amino acid positions are relative to the reference sequence corresponding to SEQ ID NO: 888.

In some embodiments, the engineered leucine decarboxylase polypeptide comprises an amino acid sequence comprising a substitution or substitution set of a variant provided in Tables 12-1 and 12-2, wherein the substitution or substitution set is relative to the reference sequence corresponding to SEQ ID NO: 12.

In some embodiments, the engineered leucine decarboxylase polypeptide comprises an amino acid sequence comprising a substitution in at least one amino acid position provided in Tables 12-1 and 12-2.

In some embodiments, the engineered leucine decarboxylase polypeptide comprises an amino acid sequence comprising at least one substitution provided in Tables 12-1 and 12-2.

In some embodiments, the engineered leucine decarboxylase polypeptide comprises an amino acid sequence comprising at least a substitution or substitution set of a variant provided in Tables 12-1 and 12-2, wherein the substitution or substitution set is relative to the reference sequence corresponding to SEQ ID NO: 828 or 888.

In some embodiments, the engineered leucine decarboxylase polypeptide comprises an amino acid sequence comprising the sequence of an engineered leucine decarboxylase provided in Tables 12-1 and 12-2.

In some embodiments, the engineered leucine decarboxylase polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to a reference sequence corresponding to an even-numbered SEQ ID NO. of SEQ ID NOS: 854-1064 (e.g., 854, 856, 858, 860, 862, 864, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, or 1064). In some embodiments, the engineered leucine decarboxylase polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to a reference sequence corresponding to an even-numbered SEQ ID NO. of SEQ ID NOS: 854-948. In some embodiments, the engineered leucine decarboxylase polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to a reference sequence corresponding to an even-numbered SEQ ID NO. of SEQ ID NOS: 950-1604.

In some embodiments, the engineered leucine decarboxylase polypeptide comprises an amino acid sequence comprising an even-numbered SEQ ID NO. of SEQ ID NOS: 854-1064. In some embodiments, the engineered leucine decarboxylase polypeptide comprises an amino acid sequence comprising an even-numbered SEQ ID NO. of SEQ ID NOS: 854-1064, wherein the amino acid sequence optionally has 1, 2, 3, 4, 5, 6, 7, 8, 9, or up to 10. In some embodiments, the engineered leucine decarboxylase polypeptide comprises an amino acid sequence comprising an even-numbered SEQ ID NO. of SEQ ID NOS: 854-948. In some embodiments, the engineered leucine decarboxylase polypeptide comprises an amino acid sequence comprising an even-numbered SEQ ID NO. of SEQ ID NOS: 854-948, wherein the polypeptide optionally has 1, 2, 3, 4, 5, 6, 7, 8, 9, or up to 10 substitutions in the amino acid sequence. In some embodiments, the engineered leucine decarboxylase polypeptide comprises an amino acid sequence comprising an even-numbered SEQ ID NO. of SEQ ID NOS: 950-1604. In some embodiments, the engineered leucine decarboxylase polypeptide comprises an amino acid sequence comprising an even-numbered SEQ ID NO. of SEQ ID NOS: 950-1604, wherein the polypeptide optionally has 1, 2, 3, 4, 5, 6, 7, 8, 9, or up to 10 substitutions in the amino acid sequence. In some embodiments, the engineered leucine decarboxylase polypeptide has 1, 2, 3, 4, or up to 5 substitutions in the amino acid sequence. In some embodiments, the engineered leucine decarboxylase polypeptide has 1, 2, 3, or 4 substitutions in the amino acid sequence. In some embodiments, the substitutions comprise non-conservative of conservative substitutions. In some embodiments, the substitutions comprise conservative substitutions. In some embodiments, the substitutions comprise non-conservative and conservative substitutions. In some embodiments, guidance on non-conservative and conservative substitutions are provided by the variants disclosed herein.

In some embodiments, the engineered leucine decarboxylase polypeptide of the present disclosure exhibits one or more improved properties as compared to the wild-type Planctomycetaceae species leucine decarboxylase or the leucine decarboxylase having the sequence corresponding to SEQ ID NO: 12. In some embodiments, the engineered leucine decarboxylase polypeptide exhibits an improved property selected from (i) increased activity on leucine, (ii) increased resistance to proteolysis, increased tolerance to low pH environments, and (iii) increased thermostability compared to the wild-type Planctomycetaceae species leucine decarboxylase or the leucine decarboxylase having the sequence corresponding to SEQ ID NO: 12.

It should be evident that the Examples provided in Tables 12-1 and 12-2, as well as in Tables 1-2, 2-1, 3-2, 4-1, 5-1, 6-1, 7-1, 8-1, 8-2, 10-1, 11-1, and 11-2 and relevant activities disclosed in WO2021158686 (incorporated by reference herein), provide sequence/structural information correlating specific amino acid sequence features with the functional activity of the engineered leucine decarboxylase polypeptides. This structure-function correlation information is provided in the form of specific amino acid residue differences relative to the reference engineered polypeptide of SEQ ID NO: 12, as well as associated experimentally determined activity data for the exemplary engineered leucine decarboxylase polypeptides, thereby providing guidance on preparation of engineered leucine decarboxylase polypeptides having the enzyme properties described herein.

In some embodiments, the engineered leucine decarboxylase polypeptide is purified. In some embodiments, the engineered leucine decarboxylase polypeptide has leucine decarboxylase activity, particularly with the improved or enhanced properties described herein.

In some embodiments, the present invention provides functional fragments or biologically active fragments of an engineered leucine decarboxylase polypeptide. In some embodiments, the functional fragments comprise at least about 90%, at least about 95%, at least about 96%, at least about 97%, at least about 98%, or at least about 99% of the activity of the engineered leucine decarboxylase polypeptide from which it was derived (i.e., the parent engineered LDC). In some embodiments, functional fragments comprise at least about 90%, at least about 91%, at least about 92%, at least about 93%, at least about 94%, at least about 95%, at least about 96%, at least about 97%, at least about 98%, or at least about 99% of the parent sequence of the engineered leucine decarboxylase. In some embodiments the functional fragment is truncated by less than 5, less than 10, less than 15, less than 10, less than 25, less than 30, less than 35, less than 40, less than 45, and less than 50 amino acids.

In some embodiments, functional fragments comprise at least 90%, 91%, 92%, 93%, 94%, 95%, 96%, 97%, 98%, or 99% of the parent sequence of the engineered leucine decarboxylase. In some embodiments the functional fragment is truncated by less than 5, less than 10, less than 15, less than 10, less than 25, less than 30, less than 35, less than 40, less than 45, less than 50, less than 55, less than 60, less than 65, or less than 70 amino acids.

In some embodiments, the functional fragments or biologically active fragments of the engineered leucine decarboxylase polypeptide described herein include at least a mutation or mutation set in the amino acid sequence of the engineered leucine decarboxylase described herein. Accordingly, in some embodiments, the functional fragments or biologically active fragments of the engineered leucine decarboxylase displays the enhanced or improved property associated with the mutation or mutation set in the parent leucine decarboxylase.

Polynucleotides Encoding Engineered Polypeptides, Expression Vectors and Host Cells In another aspect, the present disclosure provides engineered or recombinant polynucleotides encoding the engineered leucine decarboxylase polypeptides described herein. In some embodiments, the polynucleotides are operatively linked to one or more heterologous regulatory sequences that control gene expression to create a recombinant polynucleotide capable of expressing the polypeptide. In some embodiments, expression constructs containing at least one heterologous polynucleotide encoding the engineered leucine decarboxylase polypeptide(s) is introduced into appropriate host cells to express the corresponding leucine decarboxylase polypeptide(s).

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode an engineered leucine decarboxylase polypeptide. Thus, the present invention provides methods and compositions for the production of each and every possible variation of leucine decarboxylase polynucleotides that could be made that encode the leucine decarboxylase polypeptides described herein by selecting combinations based on the possible codon choices, and all such variations of polynucleotides are to be considered specifically disclosed for any polypeptide described herein, including the amino acid sequences presented in the Examples (e.g., in Tables 12-1 and/or 12-2).

In some embodiments, the codons are preferably optimized for utilization by the chosen host cell for protein production. For example, preferred codons used in bacteria are typically used for expression in bacteria. Consequently, codon optimized polynucleotides encoding the engineered leucine decarboxylase polypeptides contain preferred codons at about 40%, 50%, 60%, 70%, 80%, 90%, or greater than 90% of the codon positions in the full-length coding region.

In some embodiments, the recombinant polynucleotide encodes an engineered polypeptide having leucine decarboxylase activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence corresponding to SEQ ID NO: 828 or 888, wherein the amino acid sequence comprises one or more substitutions relative to a reference sequence corresponding to SEQ ID NO: 828 or 888, or the amino acid sequence of any variant as disclosed in the Examples.

In some embodiments, the recombinant polynucleotide encodes an engineered polypeptide having leucine decarboxylase activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or more sequence identity to reference sequence SEQ ID NO: 888.

In some embodiments, the recombinant polynucleotide encodes an engineered leucine decarboxylase polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or more sequence identity to reference sequence SEQ ID NO: 828, wherein the amino acid sequence comprises one or more substitutions relative to the reference sequence corresponding to SEQ ID NO: 828.

In some embodiments, the recombinant polynucleotide encodes the engineered leucine decarboxylase polypeptide comprising an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to the reference sequence corresponding to SEQ ID NO: 888, wherein the amino acid sequence comprises one or more substitutions relative to the reference sequence corresponding to SEQ ID NO: 828.

In some embodiments, the recombinant polynucleotide encodes the engineered leucine decarboxylase polypeptide comprising an amino acid sequence comprising at least a substitution at amino acid position 5, 19, 33, 41, 47, 51, 55, 64, 141, 170, 173, 187, 198, 200, 202, 267, 270, 272, 290, 312, 353, 357, 383, or 384, or combinations thereof, wherein the amino acid positions are relative to the reference sequence corresponding to SEQ ID NO: 828.

In some embodiments, the recombinant polynucleotide encodes the engineered leucine decarboxylase polypeptide comprising an amino acid sequence comprising at least a substitution at amino acid position 33, 55, 64, 126, 270, or 357, or combinations thereof, wherein the amino acid positions are relative to the reference sequence corresponding to SEQ ID NO: 828.

In some embodiments, the recombinant polynucleotide encodes an engineered leucine decarboxylase polypeptide comprising an amino acid sequence having at least a substitution or substitution set at amino acid position 170/270/383, 270, 41/173, 272, 5/141/272/383, 41/383, 41/141/187/272/290, 41/141/173/290, 5/272/383, 5/41/173/272/383, 41/141, 141/272, 353/384, 272/383, 41/141/173, 41/272/383, 41/141/187/200/202/272, 33/55/64/126/270/357, 33/126/353/357, 55/64/267/35/384, 33/64/357, 126/267, 64/267/353/384, 33/55/64/357, 19/64/126/267, 55/267, 33/126/267/270/312/357, 19/33/55/353/357/384, 19/33/126, 126/312, 126/198/202/267/312, 126/353, 55/126, 126/270/384, 33/64/353/357, 19/267, 51/55/267/270/353, 33/126/267/270, 19/55/64/126/267/270/353, 19/33/126/270/353/357/384, 19/33/64/267/353, 126/353/384, 126/270/312/353/384, 19/33/55/126, 33/357, 47/51/64/126/353/384, 126, or 126/270, wherein the amino acid positions are relative to the reference sequence corresponding to SEQ ID NO: 828.

In some embodiments, the recombinant polynucleotide encodes an engineered leucine decarboxylase comprising an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or more sequence identity to SEQ ID NO: 888, wherein the amino acid sequence comprises one or more substitutions relative to the reference sequence corresponding to SEQ ID NO: 888.

In some embodiments, the recombinant polynucleotide encodes an engineered leucine decarboxylase comprising an amino acid sequence comprising at least a substitution at amino acid position 5, 19, 33, 41, 47, 51, 55, 64, 141, 170, 173, 187, 198, 200, 202, 267, 270, 272, 290, 312, 353, 357, 383, or 384, or combinations thereof, wherein the amino acid positions are relative to the reference sequence corresponding to SEQ ID NO: 888.

In some embodiments, the recombinant polynucleotide encodes an engineered leucine decarboxylase polypeptide comprising an amino acid sequence comprising at least a substitution or substitution set at amino acid position 64/173/202/353/384, 41/141/272/353, 141/202/272/353/357, 173/202/357, 202/353, 5/51/173/272/353/384, 51/202/272/357, 141/173/272, 272, 41/173/384, 41/64/141/353/357/383, 141/173/202, 5/51/64/202/353, 357, 64, 5/41/141, 41/141/173/202/353, 353, 202/357, 51/141/202/272/353, 202, 51/141/173/353/384, 41/141/173/202/272/353/383/384, 64/202/357, 5/64/353/383/384, 41/272/353/383, 41/173/272/353/357, 51/141/272/353/357/383/384, 41/353/357, 173/272/353/357, 5/41/64/173/353/357, 64/173/357, 51/272, 51/64/357/384, 51/141/173/272/353, 64/202/272/353/357/384, 51/272/357, 51/173/272/353/384, 353/384, 202/272/357, 64/141/173/202/353/357, 5/41/51/202/357/383, 5/51/173/272/383, 41/141/272, 51/173, 5/353, 41/64/173/272/353/383, 5/64/173/272/353, 51/64, 41/357/383, 41/173/353/357, 202/272/383, 202/272, 353/357, 41/173/202/272/357, 141/173/202/272/353/357, 64/141/202, or 5/173/272, wherein the amino acid positions are relative to the reference sequence corresponding to SEQ ID NO: 888.

In some embodiments, the recombinant polynucleotide encodes an engineered leucine decarboxylase polypeptide comprising an amino acid sequence comprising a substitution or substitution set of a variant provided in Tables 12-1 and 12-2, wherein the substitution or substitution set is relative to the reference sequence corresponding to SEQ ID NO: 12.

In some embodiments, the recombinant polynucleotide encodes an engineered leucine decarboxylase polypeptide comprising an amino acid sequence comprising a substitution in at least one amino acid position provided in Tables 12-1 and 12-2.

In some embodiments, the recombinant polynucleotide encodes an engineered leucine decarboxylase polypeptide comprising an amino acid sequence comprising at least one substitution provided in Tables 12-1 and 12-2.

In some embodiments, the recombinant polynucleotide encodes an engineered leucine decarboxylase polypeptide comprising an amino acid sequence comprising at least a substitution or substitution set provided in Tables 12-1 and 12-2, wherein the substitution or substitution set is relative to SEQ ID NO: 828 or 888.

In some embodiments, the recombinant polynucleotide encodes an engineered leucine decarboxylase polypeptide comprising an amino acid sequence comprising a sequence of an engineered leucine decarboxylase provided in Tables 12-1 and 12-2.

In some embodiments, the recombinant polynucleotide encodes an engineered leucine decarboxylase polypeptide comprising an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence corresponding to an even-numbered SEQ ID NO. of SEQ ID NOS: 854-1064 (e.g., 854, 856, 858, 860, 862, 864, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, or 1064).

In some embodiments, the recombinant polynucleotide comprises a nucleic acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference polynucleotide sequence corresponding to SEQ ID NO: 827 or 887, wherein the recombinant polynucleotide encodes a polypeptide with leucine decarboxylase activity.

In some embodiments, the recombinant polynucleotide comprises a nucleic acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a reference sequence corresponding to an odd numbered SEQ ID NO. of SEQ ID NOS: 853-1063 (e.g., 853, 855, 857, 859, 861, 863, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, or 1063), wherein the polynucleotide encodes a polypeptide with leucine decarboxylase activity.

In some embodiments, the recombinant polynucleotide comprises a nucleic acid sequence comprising an odd numbered SEQ ID NO. of SEQ ID NOS: 853-1063 (e.g., 853, 855, 857, 859, 861, 863, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, or 1063).

In some embodiments, the recombinant polynucleotides are capable of hybridizing under highly stringent conditions to a reference polynucleotide sequence encoding an engineered leucine decarboxylase polypeptide. In some embodiments, the reference sequence is selected from SEQ ID NOS: 827 or 887, or a complement thereof, or a polynucleotide sequence encoding any of the engineered leucine decarboxylase polypeptides provided herein. In some embodiments, the recombinant polynucleotide capable of hybridizing under highly stringent conditions encodes an engineered leucine decarboxylase polypeptide comprising an amino acid sequence that has one or more residue differences as compared to SEQ ID NO: 828 or 888, at residue positions selected from any positions as set forth in Tables 12-1 and 12-2. In some further embodiments, the recombinant polynucleotides are capable of hybridizing under highly stringent conditions to a reference recombinant polynucleotide selected from those provided in Tables 12-1 and 12-2, or comprises a polynucleotide having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference nucleic acid sequence corresponding to SEQ ID NO: 827 or 887. In some additional embodiments, the recombinant polynucleotide hybridizing under highly stringent conditions comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to at least one polynucleotide reference sequence provided in Tables 12-1 and 12-2 (e.g., a nucleic acid sequence comprising an odd-numbered SEQ ID NO, of SEQ ID NOS: 853-1063), wherein the recombinant polynucleotide encodes a polypeptide having leucine decarboxylase activity.

In some embodiments, an isolated polynucleotide encoding any of the engineered leucine decarboxylase polypeptides herein is manipulated in a variety of ways to facilitate expression of the leucine decarboxylase polypeptide. In some embodiments, the polynucleotides encoding the leucine decarboxylase polypeptides comprise expression vectors where one or more control sequences is present to regulate the expression of the leucine decarboxylase polynucleotides and/or polypeptides. Manipulation of the isolated polynucleotide prior to its insertion into a vector may be desirable or necessary depending on the expression vector utilized. Techniques for modifying polynucleotides and nucleic acid sequences utilizing recombinant DNA methods are well known in the art. In some embodiments, the control sequences include among others, promoters, leader sequences, polyadenylation sequences, propeptide sequences, signal peptide sequences, and transcription terminators. In some embodiments, suitable promoters are selected based on the host cells selection. For bacterial host cells, suitable promoters for directing transcription of the nucleic acid constructs of the present disclosure, include, but are not limited to promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefa-*

*ciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA, 1978, 75:3727-3731), as well as the tac promoter (See e.g., DeBoer et al., Proc. Natl Acad. Sci. USA, 1983, 80: 21-25). Exemplary promoters for filamentous fungal host cells, include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast, 1992, 8:423-488).

In some embodiments, the control sequence is also a suitable transcription terminator sequence (i.e., a sequence recognized by a host cell to terminate transcription). In some embodiments, the terminator sequence is operably linked to the 3' terminus of the nucleic acid sequence encoding the leucine decarboxylase polypeptide. Any suitable terminator which is functional in the host cell of choice finds use in the present invention. For bacterial expression, the transcription terminators can be a Rho-dependent terminators that rely on a Rho transcription factor, or a Rho-independent, or intrinsic terminators, which do not require a transcription factor. Exemplary bacterial transcription terminators are described in Peters et al., J Mol Biol., 2011, 412(5):793-813. Exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is also a suitable leader sequence (i.e., a non-translated region of an mRNA that is important for translation by the host cell). In some embodiments, the leader sequence is operably linked to the 5' terminus of the nucleic acid sequence encoding the leucine decarboxylase polypeptide. Any suitable leader sequence that is functional in the host cell of choice find use in the present invention. Exemplary leaders for filamentous fungal host cells are obtained from the genes for *Aspergillus oryzae* TAKA amylase, and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence is also a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known (See e.g., Guo and Sherman, Mol. Cell. Bio., 1995, 15:5983-5990).

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions include, but are not limited to those obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 1993, 57:109-137). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is also a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention is directed to a recombinant expression vector comprising a polynucleotide encoding an engineered leucine decarboxylase polypeptide, and one or more expression regulating regions such as a promoter and a terminator, a replication origin, etc., depending on the type of hosts into which they are to be introduced. In some embodiments, the various nucleic acid and control sequences described herein are joined together to produce recombinant expression vectors which include one or more convenient restriction sites to allow for insertion or substitution of the nucleic acid sequence encoding the leucine decarboxylase polypeptide at such sites. Alternatively, in some embodiments, the nucleic acid sequence of the present invention is expressed by inserting the nucleic acid sequence or a nucleic acid construct comprising the sequence into an appropriate vector for expression. In some embodiments involving the creation of the expression vector, the coding sequence is located in the vector so that the coding sequence is operably linked with the appropriate control sequences for expression.

The recombinant expression vector may be any suitable vector (e.g., a plasmid or virus), that can be conveniently subjected to recombinant DNA procedures and bring about the expression of the leucine decarboxylase polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated. Furthermore, in some embodiments, a single vector or plasmid, or two or more vectors or plasmids which together contain the total DNA to be introduced into the genome of the host cell, and/or a transposon is utilized.

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or *A. oryzae*), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or *A. oryzae*), sC (sulfate adenyltransferase), and trpC (anthranilate synthase), as well as equivalents thereof.

In another aspect, the present invention provides a host cell comprising at least one polynucleotide encoding at least one engineered leucine decarboxylase polypeptide of the present invention, the polynucleotide(s) being operatively linked to one or more control sequences for expression of the engineered leucine decarboxylase enzyme(s) in the host cell. Host cells suitable for use in expressing the polypeptides encoded by the expression vectors of the present invention are well known in the art and include but are not limited to, bacterial cells, such as *E. coli*, *Vibrio fluvialis*, *Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells also include various *Escherichia coli* strains (e.g., W3110 (ΔfhuA) and BL21).

Accordingly, in another aspect, the present invention provides methods of producing the engineered leucine decarboxylase polypeptides, where the methods comprise culturing a host cell capable of expressing a polynucleotide encoding the engineered leucine decarboxylase polypeptide under conditions suitable for expression of the polypeptide. In some embodiments, the methods further comprise recovering the engineered leucine decarboxylase polypeptide from the culture and/or host cells. In some embodiments, the methods further comprise the steps of isolating and/or purifying the leucine decarboxylase polypeptides, as described herein.

Appropriate culture media and growth conditions for host cells are well known in the art. It is contemplated that any suitable method for introducing polynucleotides for expression of the leucine decarboxylase polypeptides into cells will find use in the present invention. Suitable techniques include, but are not limited to electroporation, biolistic particle bombardment, liposome mediated transfection, calcium chloride transfection, and protoplast fusion.

Engineered leucine decarboxylase polypeptides with the properties disclosed herein can be obtained by subjecting the polynucleotide encoding the naturally occurring or engineered leucine decarboxylase polypeptide to any suitable mutagenesis and/or directed evolution methods known in the art, and/or as described herein. An exemplary directed evolution technique is mutagenesis and/or DNA shuffling (See e.g., Stemmer, Proc. Natl. Acad. Sci. USA, 1994, 91:10747-10751; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 1998, 16:258-261), mutagenic PCR (See e.g., Caldwell et al., PCR Methods Appl., 1994, 3:S136-S140), and cassette mutagenesis (See e.g., Black et al., Proc. Natl. Acad. Sci. USA, 1996, 93:3525-3529).

Mutagenesis and directed evolution methods can be readily applied to leucine decarboxylase—encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, 9,665,694, 9,684,771, and all related US and non-US counterparts; Ling et al., Anal. Biochem., 1997, 254(2):157-78; Dale et al., Meth. Mol. Biol., 1996, 57:369-74; Smith, Ann. Rev. Genet., 1985, 19:423-462; Botstein et al., Science, 1985, 229:1193-1201; Carter, Biochem. J., 1986, 237:1-7; Kramer et al., Cell, 1984, 38:879-887; Wells et al., Gene, 1985, 34:315-323; Minshull et al., Curr. Op. Chem. Biol., 1999, 3:284-290; Christians et al., Nat. Biotechnol., 1999, 17:259-264; Crameri et al., Nature, 1998, 391:288-291; Crameri, et al., Nat. Biotechnol., 1997, 15:436-438; Zhang et al., Proc. Nat. Acad. Sci. U.S.A., 1997, 94:4504-4509; Crameri et al., Nat. Biotechnol., 1996, 14:315-319; Stemmer, Nature, 1994, 370:389-391; Stemmer, Proc. Nat. Acad. Sci. USA, 1994, 91:10747-10751; WO 95/22625; WO 97/0078; WO 97/35966; WO 98/27230; WO 00/42651; WO 01/75767; WO 2009/152336; and U.S. Pat. Appln. Publ. Nos. 2011/0082055, 2014/0005057, 2014/0214391, 2014/0221216, 2015/0133307, 2015/0134315, and 2015/0050658; all of which are incorporated herein by reference).

In some embodiments, the enzyme clones obtained following mutagenesis treatment are screened by subjecting the enzyme preparations to a defined temperature (or other assay conditions) and measuring the amount of enzyme activity remaining after heat treatments or other suitable assay conditions. Clones containing a polynucleotide encoding a leucine decarboxylase polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tet. Lett., 1981, 22:1859-69; and Matthes et al., EMBO J., 1984, 3:801-05), as it is typically practiced in automated synthetic methods. According to the phosphoramidite method, oligonucleotides are synthesized (e.g., in an automatic DNA synthesizer, purified, annealed, ligated and cloned in appropriate vectors).

Accordingly, in some embodiments, a method for preparing the engineered leucine decarboxylase polypeptide can comprise: (a) synthesizing a polynucleotide encoding a polypeptide comprising an amino acid sequence selected from the amino acid sequence of any variant as described herein, and (b) expressing the leucine decarboxylase polypeptide encoded by the polynucleotide. In some embodiments of the method, the amino acid sequence encoded by the polynucleotide can optionally have one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions are conservative or non-conservative substitutions.

In some embodiments, the expressed engineered leucine decarboxylase polypeptide can be evaluated for any desired improved property or combination of properties (e.g., activity, selectivity, stability, etc.) using any suitable assay known in the art, including but not limited to the assays and conditions described herein.

In some embodiments, any of the engineered leucine decarboxylase polypeptides expressed in a host cell are recovered from the cells and/or the culture medium using any one or more of the well-known techniques for protein purification, including, among others, lysozyme treatment, sonication, filtration, salting-out, ultra-centrifugation, and chromatography.

Chromatographic techniques for isolation of the leucine decarboxylase polypeptides include, among others, reverse phase chromatography, high-performance liquid chromatography, ion-exchange chromatography, hydrophobic-interaction chromatography, size-exclusion chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved leucine decarboxylase enzymes. For affinity chromatography purification, any antibody that specifically binds a leucine decarboxylase polypeptide of interest may find use. For the production of antibodies, various host animals, including but not limited to rabbits, mice, rats, etc., are immunized by injection with a leucine decarboxylase polypeptide, or a fragment thereof. In some embodiments, the leucine decarboxylase polypeptide or fragment is attached to a suitable carrier, such as BSA, by means of a side chain functional group or linkers attached to a side chain functional group.

In some embodiments, the engineered leucine decarboxylase polypeptide is produced in a host cell by a method comprising culturing a host cell (e.g., an *E. coli* strain) comprising a polynucleotide sequence encoding an engineered leucine decarboxylase polypeptide as described herein under conditions conducive to the production of the engineered leucine decarboxylase polypeptide and recovering the engineered leucine decarboxylase polypeptide from the cells and/or culture medium. In some embodiments, the host cell produces more than one engineered leucine decarboxylase polypeptide.

Compositions

In another aspect, the engineered leucine decarboxylase polypeptides of the disclosure are prepared as compositions for various uses. These compositions find use in many fields, including but not limited to pharmaceuticals, dietary/nutritional supplements, food, feed, and fine chemical production. For example, in some embodiments, the present invention provides food and/or feeds comprising at least one engineered leucine decarboxylase variant and/or at least one polynucleotide sequence encoding at least one leucine decarboxylase variant. In some embodiments, the present invention provides beverages comprising at least one engineered leucine decarboxylase variant.

In some embodiments, the engineered leucine decarboxylase variant in food, feed, and/or nutritional/dietary supplement is glycosylated. Furthermore, the engineered leucine decarboxylase variants find use in any suitable edible enzyme delivery matrix. In some embodiments, the engineered leucine decarboxylase variants are present in an edible enzyme delivery matrix designed for rapid dispersal of the leucine decarboxylase variant within the digestive tract of an animal upon ingestion of the variant.

In some embodiments, the engineered leucine decarboxylase polypeptides are used in the production of fine chemicals and other industrially important compounds (See e.g., US Pat. Appln. Nos. 2013/0340119, 2013/0005012, and 2005/0260724, and WO 2012/122333).

Pharmaceutical and Other Compositions

The present disclosure also provides engineered leucine decarboxylase polypeptides suitable for use in pharmaceutical and other compositions, such as dietary/nutritional supplements.

Depending on the mode of administration, these compositions comprising a therapeutically effective amount of an engineered leucine decarboxylase according to the invention are in the form of a solid, semi-solid, or liquid. In some embodiments, the compositions include other pharmaceutically acceptable components such as diluents, buffers, excipients, salts, emulsifiers, preservatives, stabilizers, fillers, and other ingredients. Details on techniques for formulation and administration are well known in the art and described in the literature.

In some embodiments, the engineered leucine decarboxylase polypeptides are formulated for use in oral pharmaceutical compositions. Any suitable format for use in delivering the engineered leucine decarboxylase polypeptides find use in the present invention, including but not limited to pills, tablets, gel tabs, capsules, lozenges, dragees, powders, soft gels, sol-gels, gels, emulsions, implants, patches, sprays, ointments, liniments, creams, pastes, jellies, paints, aerosols, chewing gums, demulcents, sticks, suspensions (including but not limited to oil-based suspensions, oil-in water emulsions, etc.), slurries, syrups, controlled release formulations, suppositories, etc. In some embodiments, the engineered leucine decarboxylase polypeptides are provided in a format suitable for injection (i.e., in an injectable formulation). In some embodiments, the engineered leucine decarboxylase polypeptides are provided in biocompatible matrices such as sol-gels, including silica-based (e.g., oxysilane) sol-gels. In some embodiments, the engineered leucine decarboxylase polypeptides are encapsulated. In some alternative embodiments, the engineered leucine decarboxylase polypeptides are encapsulated in nanostructures (e.g., nanotubes, nanotubules, nanocapsules, or microcapsules, microspheres, liposomes, etc.). Indeed, it is not intended that the present invention be limited to any particular delivery formulation and/or means of delivery. It is intended that the engineered leucine decarboxylase polypeptides be administered by any suitable means known in the art, including but not limited to parenteral, oral, topical, transdermal, intranasal, intraocular, intrathecal, via implants, etc.

In some further embodiments, the pharmaceutical composition further comprises coenzyme pyridoxal-5-phosphate. In some embodiments, the pyridoxal-5-phosphate may be formulated with an engineered leucine decarboxylase as a stable composition or prepared shortly before administration.

In some embodiments, the engineered leucine decarboxylase polypeptides are chemically modified by glycosylation, PEGylation (i.e., modified with polyethylene glycol [PEG] or activated PEG, etc.) or other compounds (See e.g., Ikeda, Amino Acids, 2005, 29:283-287; U.S. Pat. Nos. 7,531,341, 7,534,595, 7,560,263, and 7,553,653; US Pat. Appln. Publ. Nos. 2013/0039898, 2012/0177722, etc.). Indeed, it is not intended that the present invention be limited to any particular delivery method and/or mechanism.

In some additional embodiments, the engineered leucine decarboxylase polypeptides are provided in formulations comprising matrix-stabilized enzyme crystals. In some embodiments, the formulation comprises a cross-linked crystalline engineered leucine decarboxylase enzyme and a polymer with a reactive moiety that adheres to the enzyme crystals. The present invention also provides engineered leucine decarboxylase polypeptides in polymers.

In some embodiments, compositions comprising the engineered leucine decarboxylase polypeptides of the present invention include one or more commonly used carrier compounds, including but not limited to sugars (e.g., lactose, sucrose, mannitol, and/or sorbitol), starches (e.g., corn, wheat, rice, potato, or other plant starch), cellulose (e.g., methyl cellulose, hydroxypropyl methyl cellulose, sodium carboxy-methylcellulose), gums (e.g., arabic, tragacanth, guar, etc.), and/or proteins (e.g., gelatin, collagen, etc.). Additional components in oral formulations may include coloring and or sweetening agents (e.g., glucose, sucrose, and mannitol) and lubricating agents (e.g., magnesium stearate), as well as enteric coatings (e.g., methacrylate polymers, hydroxyl propyl methyl cellulose phthalate, and/or any other suitable enteric coating known in the art). In some embodiments, disintegrating or solubilizing agents are included (e.g., cross-linked polyvinyl pyrrolidone, agar, alginic acid or salts thereof, such as sodium alginate). In some embodiments, the engineered leucine decarboxylase polypeptide are combined with various additional components, including but not limited to preservatives, suspending agents, thickening agents, wetting agents, alcohols, fatty acids, and/or emulsifiers, particularly in liquid formulations.

In some embodiments, the engineered leucine decarboxylase polypeptide are be combined with various additional components, including but not limited to preservatives, suspending agents, thickening agents, wetting agents, alcohols, fatty acids, and/or emulsifiers, particularly in liquid formulations. In some embodiments, the engineered leucine decarboxylase polypeptides are administered to subjects in combination with other compounds used in the treatment of MSUD, as well as any other suitable compounds.

In some embodiments, the present invention provides engineered leucine decarboxylase polypeptides suitable for use in decreasing, ameliorating, or eliminating the signs and/or symptoms of MSUD, as described herein. The dosage of engineered leucine decarboxylase polypeptide(s) administered to a patient depends upon the genotype of the patient, the general condition of the patient, and other factors known to those in the art. In some embodiments, the compositions are intended for single or repeat administration to a patient. In some embodiments, it is contemplated that the concentration of engineered leucine decarboxylase polypeptide(s) in the composition(s) administered to a patient is sufficient to effectively treat, ameliorate and/or prevent the symptoms of the disease. In some embodiments, the engineered leucine decarboxylase polypeptides are administered in combination with other pharmaceutical and/or dietary compositions.

Industrial Compositions

It is contemplated that the engineered leucine decarboxylase polypeptides of the present invention will find use in industrial compositions, including such areas as food flavorings (e.g., cheese).

In some embodiments, the engineered leucine decarboxylase polypeptides are formulated for use in the food and/or feed industries. In some embodiments, the engineered leucine decarboxylase polypeptides are formulated in granulated or pelleted products which are mixed with animal feed components such as additional enzymes (for example, cellulases, laccases, and amylases). In some alternative embodiments, the engineered leucine decarboxylase polypeptides are used in liquid animal feed compositions (e.g., aqueous or oil-based slurries). Thus, in some embodiments, the engineered leucine decarboxylase variants of the present invention are sufficiently thermotolerant and thermostable to withstand the treatment used to produce pellets and other processed feed/foods.

Therapeutic Uses and Methods

In another aspect, the engineered leucine decarboxylase polypeptides find use for treating and/or preventing the symptoms of conditions associated with dysfunction in leucine, isoleucine, and/or alloisoleucine metabolism. In some embodiments, the subject for treatment to reduce levels of plasma leucine, isoleucine, alloisoleucine and/or ketoisocaproic acid has an organic acidemia or inborn error of amino acid metabolism. In some embodiments, the subject for treatment to reduce levels of plasma leucine, isoleucine, alloisoleucine and/or ketoisocaproic acid has elevated leucine levels caused by unknown etiology.

In some embodiments, the engineered leucine decarboxylase polypeptides are used for treating and/or preventing the symptoms of a disease or condition associated with elevated plasma leucine, isoleucine, alloisoleucine and/or ketoisocaproic acid levels. In some embodiments, a method of treating and/or preventing the symptoms of a disease or condition associated with elevated plasma leucine, isoleucine, alloisoleucine and/or ketoisocaproic acid levels comprises administering to a subject in need thereof an effective amount of an engineered leucine decarboxylase to decrease levels of plasma leucine, isoleucine, alloisoleucine and/or ketoisocaproic acid in the subject.

In some embodiments, the disease or condition associated with elevated plasma leucine, isoleucine, alloisoleucine and/or ketoisocaproic acid levels is maple syrup urine disease. In some embodiments, the disease or condition associated with elevated plasma leucine, isoleucine, alloisoleucine and/or ketoisocaproic acid levels is isovaleric acidemia. In some embodiments, the disease or condition associated with elevated plasma leucine, isoleucine, alloisoleucine and/or ketoisocaproic acid levels is 3-methylcrotonyl-CoA carboxylase deficiency.

In some embodiments, the engineered leucine decarboxylase polypeptides are used to reduce plasma leucine, isoleucine, valine, methionine, cysteine, phenylalanine, alloisoleucine, and/or ketoisocaproic acid levels in a subject. In some embodiments, the levels of leucine, isoleucine, valine, methionine, cysteine, phenylalanine, alloisoleucine and/or ketoisocaproic acid can be used as indicators of disease or condition, for example, associated with dysfunction in amino acid metabolism and/or as markers for effectiveness of treatment with an engineered leucine decarboxylase polypeptide. In some embodiments, the engineered leucine decarboxylase polypeptides are used to reduce plasma leucine, isoleucine, valine, methionine, cysteine, phenylalanine, alloisoleucine and/or ketoisocaproic acid levels in a subject, the method comprising administering to a subject in need thereof an effective amount of an engineered leucine decarboxylase.

In some embodiments, the engineered leucine decarboxylase polypeptides are used to reduce plasma leucine, isoleucine, alloisoleucine and/or ketoisocaproic acid levels in a subject, the method comprising administering to a subject in need thereof an effective amount of an engineered leucine decarboxylase. In some embodiments, the subject for treatment to reduce levels of plasma leucine, isoleucine, alloisoleucine and/or ketoisocaproic acid has maple syrup urine disease. In some embodiments, the subject for treatment to reduce levels of plasma leucine, isoleucine, alloisoleucine and/or ketoisocaproic acid has isovaleric acidemia. In some embodiments, the subject for treatment to reduce levels of plasma leucine, isoleucine, alloisoleucine and/or ketoisocaproic acid has 3-methylcrotonyl-CoA carboxylase deficiency.

In some embodiments, for treatment and/or prevention of the symptoms of conditions associated with dysfunction in leucine, isoleucine, and/or alloisoleucine metabolism, or for reducing levels of plasma leucine, isoleucine, alloisoleucine and/or ketoisocaproic acid in a subject, the engineered leucine decarboxylase polypeptide is administered at an effective dose.

In some embodiments, the engineered leucine decarboxylase polypeptide is administered at a dose of 1 mg/kg to 500 mg/kg. In some embodiments, the engineered leucine decarboxylase polypeptide is administered at a dose of 1 mg/kg to 400 mg/kg. In some embodiments, the engineered leucine decarboxylase polypeptide is administered at a dose of about 1 mg/kg to 200 mg/kg. In some embodiments, the engineered leucine decarboxylase polypeptide is administered at a dose of about 2 mg/kg to about 300 mg/kg, or about 5 mg/kg to about 200 mg/kg. In some embodiments, the engineered leucine decarboxylase polypeptide is administered at a dose of about 1 mg/kg, about 5 mg/kg, about 10 mg/kg, about 20 mg/kg, about 30 mg/kg, about 40 mg/kg, about 50 mg/kg, about 60 mg/kg, about 70 mg/kg, about 80 mg/kg, about 90 mg/kg, about 100 mg/kg, about 120 mg/kg, about 140 mg/kg, about 160 mg/kg, about 180 mg/kg, about 200 mg/kg, about 250 mg/kg, about 300 mg/kg, about 350 mg/kg, or about 400 mg/kg. In some embodiments, the engineered leucine decarboxylase polypeptide is administered at a dose of 1 mg/kg to less than 25 mg/kg. In some embodiments, the engineered leucine decarboxylase polypeptide is administered at a dose of 5 mg/kg to less than 25 mg/kg. In some embodiments, the engineered leucine decarboxylase polypeptide is administered at a dose of about 6.25 mg/kg to about 12.5 mg/kg. In some embodiments, the engineered leucine decarboxylase polypeptide is administered at a dose of about 6.25 mg/kg. In some embodiments, the engineered leucine decarboxylase polypeptide is administered at a dose of about 12.5 mg/kg.

In some embodiments for the treatment of maple syrup urine disease, the engineered leucine decarboxylase polypeptide is administered at a dose of 1 mg/kg to less than 25 mg/kg. In some embodiments for the treatment of maple syrup urine disease, the engineered leucine decarboxylase polypeptide is administered at a dose of 5 mg/kg to less than 25 mg/kg. In some embodiments, the engineered leucine decarboxylase polypeptide is administered at a dose of about 6.25 mg/kg to about 12.5 mg/kg. In some embodiments, the engineered leucine decarboxylase polypeptide is administered at a dose of about 6.25 mg/kg. In some embodiments, the engineered leucine decarboxylase polypeptide is administered at a dose of about 12.5 mg/kg.

In some embodiments, the engineered leucine decarboxylase polypeptides are used to reduce plasma leucine, isoleucine, valine, methionine, cysteine, phenylalanine, alloisoleucine and/or ketoisocaproic acid levels in a subject. In some embodiments, the engineered leucine decarboxylase polypeptide is administered in an effective amount to reduce plasma leucine, ketoisocaproic acid, and methionine levels in a subject in need thereof. In some embodiments, the engineered leucine decarboxylase polypeptide is administered to the subject in at least two or more consecutive days. In some embodiments, the engineered leucine decarboxylase polypeptide is administered to the subject in at least three or more consecutive days. In some embodiments, the engineered leucine decarboxylase polypeptide is administered continuously, e.g., weeks, months, years, and/or as necessary to treat the subject in need thereof.

In some embodiments, for treatment and/or prevention of the symptoms of conditions associated with dysfunction in leucine, isoleucine, and/or alloisoleucine metabolism, or for reducing levels of plasma leucine, isoleucine, alloisoleucine and/or ketoisocaproic acid in a subject, the engineered leucine decarboxylase polypeptide is administered at dose to reduce plasma or serum leucine levels by about 5% or more, 10% or more, 15% or more, 20% or more, 25% or more, 30% or more, 40% or more, and/or 50% or more, as compared to their baseline leucine levels in untreated subjects with the disease or disorder.

In some embodiments, for treatment and/or prevention of the symptoms of conditions associated with dysfunction in leucine, isoleucine, and/or alloisoleucine metabolism, or for reducing levels of plasma leucine, isoleucine, alloisoleucine and/or ketoisocaproic acid in a subject, the engineered leucine decarboxylase polypeptide is administered immediately before, concurrently with, and/or immediately following ingestion of a meal containing protein.

In some embodiments, for any of the methods herein, an engineered leucine decarboxylase polypeptide may be administered in combination with coenzyme pyridoxal-5-phosphate. In some embodiments, an engineered leucine decarboxylase polypeptide can be formulated with pyridoxal-5-phosphate prior to administration. In some embodiments, the pyridoxal-5-phosphate is administered concurrently with the administration of an engineered leucine decarboxylase polypeptide.

In some embodiments, the subject treated with the engineered leucine decarboxylase polypeptide has maple syrup urine disease, and wherein the symptoms of maple syrup urine disease are ameliorated. In some embodiments, the subject treated with the engineered leucine decarboxylase polypeptide has isovaleric acidemia, and wherein the symptoms of isovaleric acidemia are ameliorated. In some embodiments, the subject treated with the engineered leucine decarboxylase polypeptide has 3-methylcrotonyl-CoA carboxylase deficiency, and wherein the symptoms of 3-methylcrotonyl-CoA carboxylase deficiency are ameliorated. In some embodiments, the subject is able to eat a diet that is less restricted in leucine, isoleucine, and/or valine content compared to diets required by subjects who are afflicted with the disease. In some embodiments, the subject is an infant, child, young adult, or adult.

In some embodiments, the engineered leucine decarboxylase polypeptides useful for the therapeutic methods and uses herein include the engineered leucine decarboxylase polypeptides described above and those described in International Patent publication WO2021158686 and its corresponding Sequence Listing, which are incorporated herein by reference in their entirety. These engineered leucine decarboxylase polypeptides are also presented in the Appendix (in Tables 1-2, 2-1, 3-2, 4-1, 5-1, 6-1, 7-1, 8-1, 8-2, 10-1, 11-1, and 11-2), and the incorporated Sequence Listing of the present disclosure.

In some embodiments of the therapeutic uses and methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to at least one of SEQ ID NO: 2, 4, 6, 8, 10, 12, 14, 38, 234, 284, 484, 594, 686, 688, 766, 828, and/or 888. In some embodiments, the engineered leucine decarboxylase polypeptide comprises one or more substitutions relative to the reference sequence of SEQ ID NO: 2, 4, 6, 8, 10, 12, 14, 38, 234, 284, 484, 594, 686, 688, 766, 828, or 888.

In some embodiments, the engineered leucine decarboxylase polypeptide comprises amino acid sequences having at 85%, 86%, 87%, 88%, 89%, 90%, 91%, 92%, 93%, 94%, 95%, 96%, 97%, 98%, 99%, or more sequence identity to a reference sequence corresponding to SEQ ID NO: 2, 4, 6, 8, 10, 12, 14, 38, 234, 284, 484, 594, 686, 688, 766, 828, or 888, wherein the amino acid sequence comprises one or more substitutions relative to the reference sequence corresponding to SEQ ID NO: 2, 4, 6, 8, 10, 12, 14, 38, 234, 284, 484, 594, 686, 688, 766, 828, or 888.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 2.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 4.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 6.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 8.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 10.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 14.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to a reference sequence corresponding to SEQ ID NO: 12, 38, 234, 284, 484, 594, 686, 688, 766, 828, or 888, wherein the amino acid sequence comprises one or more substitutions relative to the reference sequence corresponding to SEQ ID NO: 12, 38, 234, 284, 484, 594, 686, 688, 766, 828, or 888.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to a reference sequence corresponding to SEQ ID NO: 12, 38, 234, 284, 484, 594, 686, 688, 766, 828, or 888, wherein the amino acid sequence comprises one or more substitutions relative to the reference sequence corresponding to SEQ ID NO: 12.

In some embodiments, the amino acid sequence of the engineered leucine decarboxylase comprises at least a substitution at amino acid position 2, 3, 5, 12, 14, 16, 19, 33, 34, 38, 39, 41, 47, 48, 51, 55, 63, 64, 66, 69, 76, 77, 80, 87, 89, 91, 92, 102, 106, 109, 118, 123, 126, 127, 132, 134, 135, 139, 140, 141, 156, 161, 164, 168, 170, 173, 181, 187, 189, 193, 194, 196, 198, 200, 201, 202, 211, 223, 228, 245, 255, 256, 259, 262, 263, 265, 267, 270, 272, 275, 290, 296, 299, 300, 303, 304, 312, 317, 319, 324, 328, 331, 338, 339, 340, 343, 349, 350, 352, 353, 357, 364, 365, 365, 366, 379, 380, 381, 382, 383, 384, 386, 388, 389, 390, 391, 393, 394, 395, 397, 398, 401, 404, or 405, or combinations thereof, wherein the amino acid positions are relative to the reference sequence corresponding to SEQ ID NO: 12.

In some embodiments, the amino acid sequence of the engineered leucine decarboxylase comprises at least a substitution 2E, 3M, 5M/V, 12G, 14I/T, 16Q/V, 19I/L, 33L, 34L, 38V, 39N/S, 41D, 47F, 48L, 51Q/E, 55I, 63C, 64S/A/N/E, 66S/N, 69I, 76V, 77L, 80G/K, 87R, 89P, 91A/Q, 92K, 102S, 106M, 109G, 118T/D, 123F/M/V, 126A/T, 127S, 132F, 134A/S, 135V, 139G, 140V, 141P, 156A/S, 161V, 164A/C, 168K, 170A/P, 173A/I/T, 181K/R/V, 187L, 189A/D, 193I, 194C/L, 196D/R, 198G, 200S, 201D/R, 202H, 211S, 223M, 228D, 245M, 255G/N/P/H, 256W, 259K/L/Q, 262D/G/H/I/S/T, 263T/V, 265P, 267L/I, 270R/A/T/L, 272A, 275S, 290I, 296D/E, 299A, 300R/K, 303Q, 304R, 312A/T, 317Q, 319A, 324N/S/M/N/T, 328N, 331V, 338S, 339A/D, 340T/V, 343A/E, 349T, 350S/E, 352A, 353I/L/D/N/S/W/E, 357S/C/MN, 364K/R, 365E, 365E, 366A/M/Q/T/V, 379D/N/P/E, 380E, 381D/E, 382G/S, 383S, 384W, 386*, 388A, 389G/P/Q, 390A/S/E/*, 391E/*, 393T, 394E, 395A/D/G/K/S, 397A, 398*, 401Y/*, 404I, or 405D/H/L/E, or combinations thereof, wherein the amino acid positions are relative to the reference sequence corresponding to SEQ ID NO: 12.

In some further embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 12, and wherein the amino acid sequence of the engineered leucine decarboxylase polypeptide comprises at least a substitution or substitution set at amino acid position 5, 14, 14/34/38/39/102/267/275/350/357, 14/39/102/127/245/267/275/349/350, 34/38/39/102/127/275/357, 34/38/39/102/275/357, 34/38/39/127/245/349/350/357, 34/38/39/127/245/350/357, 34/39/102/127/264/275/357, 34/39/102/127/275/349/357, 34/39/102/264/275/350/357, 34/39/275/349/350/357, 38/39/102/127/264/267/350/357, 38/39/102/127/267/275/349/350/357, 38/39/102/127/349/350/357, 38/39/102/127/350, 38/39/102/127/350/357, 38/39/127/245/267/357, 38/39/127/264/275, 38/39/127/264/350/357, 38/39/127/350/357, 38/39/127/357, 38/39/245/275/357, 38/39/264/267/275/350, 38/39/264/275/357, 38/39/275, 38/39/275/350, 39, 39/102/127/264/275/357, 39/102/264/275/357, 39/102/267/275/357, 39/127/245/264/267/275/350, 39/127/245/264/275/350/357, 39/127/245/357, 39/127/267/275/350/357, 39/127/267/350/357, 39/127/357, 39/245/264/267/275/357, 39/264/267/275/350, 39/275/350/357, 48, 139, 164, 196, 255, 299, 318, 324, 339, 343, 350, 353, 357, 364, 365, 379, 381, 386, 389, 391, 393, 394, 395, 397, 398, or 405, wherein the amino acid positions are relative to the reference sequence corresponding to SEQ ID NO: 12. In some additional embodiments, the amino acid sequence of the engineered leucine decarboxylase polypeptide comprises at least a substitution or substitution set 5M, 14I, 14T/34L/38V/39N/102S/267I/275S/350E/357V, 14T/39N/102S/127S/245M/267I/275S/349T/350E, 34L/38V/39N/102S/127S/275S/357V, 34L/38V/39N/102S/275S/357V, 34L/38V/39N/127S/245M/349T/350E/357V, 34L/38V/39N/127S/245M/350E/357V, 34L/39N/102S/127S/264V/275S/357V, 34L/39N/102S/127S/275S/349T/357V, 34L/39N/102S/264V/275S/350E/357V, 34L/39N/275S/349T/350E/357V, 38V/39N/102S/127S/264V/267I/350E/357V, 38V/39N/102S/127S/267I/275S/349T/350E/357V, 38V/39N/102S/127S/349T/350E/357V, 38V/39N/102S/127S/350E, 38V/39N/102S/127S/350E/357V, 38V/39N/127S/245M/267I/357V, 38V/39N/127S/264V/275S, 38V/39N/127S/264V/350E/357V, 38V/39N/127S/350E/357V, 38V/39N/127S/357V, 38V/39N/245M/275S/357V, 38V/39N/264V/267I/275S/350E, 38V/39N/264V/275S/357V, 38V/39N/275S, 38V/39N/275S/350E, 39N/102S/127S/264V/275S/357V, 39N/102S/264V/275S/357V, 39N/102S/267I/275S/357V, 39N/127S/245M/264V/267I/275S/350E, 39N/127S/245M/264V/275S/350E/357V, 39N/127S/245M/357V, 39N/127S/267I/275S/350E/357V, 39N/127S/267I/350E/357V, 39N/127S/357V, 39N/245M/264V/267I/275S/357V, 39N/264V/267I/275S/350E, 39N/275S/350E/357V, 39S, 48F, 139G, 164A, 164C, 196D, 196R, 255G, 255N, 255P, 299A, 299V, 318K, 324M, 324S, 324T, 339A, 339D, 343A, 343E, 350S, 353D, 353E, 353L, 353N, 353S, 353W, 357C, 357M, 364K, 364R, 365E, 379D, 379P, 381D, 381E, 386*, 389E, 389G, 389P, 389Q, 391*, 391E, 393T, 394E, 395A, 395D, 395G, 395K, 395S, 397A, 398*, 405D, 405E, 405H, or 405L, wherein the amino acid positions are relative to the reference sequence corresponding to SEQ ID NO: 12. In some additional embodiments, the amino acid sequence of the engineered leucine decarboxylase polypeptide comprises at least a substitution or substitution set K5M, H14I, H14T/I34L/C38V/T39N/T102S/V267I/T275S/N350E/I357V, H14T/T39N/T102S/T127S/I245M/V267I/T275S/V349T/N350E, I34L/C38V/T39N/T102S/T127S/T275S/I357V, I34L/C38V/T39N/T102S/

T275S/I357V, I34L/C38V/T39N/T127S/I245M/V349T/N350E/I357V, I34L/C38V/T39N/T127S/I245M/N350E/I357V, I34L/T39N/T102S/T127S/I264V/T275S/I357V, I34L/T39N/T102S/T127S/T275S/V349T/I357V, I34L/T39N/T102S/I264V/T275S/N350E/I357V, I34L/T39N/T275S/V349T/N350E/I357V, C38V/T39N/T102S/T127S/I264V/V267I/N350E/I357V, C38V/T39N/T102S/T127S/V267I/T275S/V349T/N350E/I357V, C38V/T39N/T102S/T127S/V349T/N350E/I357V, C38V/T39N/T102S/T127S/N350E, C38V/T39N/T102S/T127S/N350E/I357V, C38V/T39N/T127S/I245M/V267I/I357V, C38V/T39N/T127S/I264V/T275S, C38V/T39N/T127S/I264V/N350E/I357V, C38V/T39N/T127S/N350E/I357V, C38V/T39N/T127S/I357V, C38V/T39N/I245M/T275S/I357V, C38V/T39N/I264V/V267I/T275S/N350E, C38V/T39N/I264V/T275S/I357V, C38V/T39N/T275S, C38V/T39N/T275S/N350E, T39N/T102S/T127S/I264V/T275S/I357V, T39N/T102S/I264V/T275S/I357V, T39N/T102S/V267I/T275S/I357V, T39N/T127S/I245M/I264V/V267I/T275S/N350E, T39N/T127S/I245M/I264V/T275S/N350E/I357V, T39N/T127S/I245M/I357V, T39N/T127S/V267I/T275S/N350E/I357V, T39N/T127S/V267I/N350E/I357V, T39N/T127S/I357V, T39N/I245M/I264V/V267I/T275S/I357V, T39N/I264V/V267I/T275S/N350E, T39N/T275S/N350E/I357V, T39S, L48F, N139G, I164A, I164C, K196D, K196R, H255G, H255N, H255P, K299A, K299V, R318K, R324M, R324S, R324T, Q339A, Q339D, H343A, H343E, N350S, R353D, R353E, R353L, R353N, R353S, R353W, I357C, I357M, L364K, L364R, Q365E, K379D, K379P, A381D, A381E, D386*, K389E, K389G, K389P, K389Q, A391*, A391E, K393T, K394E, R395A, R395D, R395G, R395K, R395S, T397A, P398*, T405D, T405E, T405H, or T405L, wherein the amino acid positions are relative to the reference sequence corresponding to SEQ ID NO: 12.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 38, and wherein the amino acid sequence of said engineered leucine decarboxylase polypeptide comprises at least a substitution or substitution set at amino acid position 48/64/164/324/343/353/357/364, 48/64/164/324/343/364, 48/64/164/353/357/364, 48/64/357/364, 64/164/324/343/353/357/364, 64/164/353/357, 64/318/324/357/364, 64/324/353/357/364, 132/255/339/379/395, 164/196/324/357/364, 164/318/324/343/353/357, 164/318/324/357/364, 164/324/343/353/357/364, 164/324/357/364, 164/353/357/364, 164/364, 196/318/324/353/357/364, 318/343/357, 324/343/357/364, 324/353/357/364, 324/357/364, 339/379/389/394/395, 339/389/395, 339/391, 339/394/395/405, 357/364, 379/386, 379/394/395/397/404/405, 379/394/395/397/405, 389/394/395/397/405, and 394/397, wherein the amino acid positions are relative to the reference sequence corresponding to SEQ ID NO: 38. In some additional embodiments, the amino acid sequence of the engineered leucine decarboxylase polypeptide comprises at least a substitution or substitution set 48F/64E/164A/324M/343E/353E/357C/364K, 48F/64E/164A/324M/343E/364R, 48F/64E/164C/353N/357V/364R, 48F/64E/357M/364K, 64E/164A/324M/343E/353D/357V/364K, 64E/164A/324M/343E/357C/364R, 64E/164C/353D/357V, 64E/318K/324S/357V/364R, 64E/324M/353N/357C/364R, 132F/255P/339A/379D/395D, 164A/196D/324M/357C/364K, 164A/318K/324M/343E/353E/357C, 164A/324M/343E/353D/357C/364R, 164A/324M/357C/364K, 164A/353W/357C/364R, 164A/364R, 164C/318K/324S/357V/364R, 164C/324M/343E/353D/357V/364R, 164C/353D/357V/364K, 164C/353D/357V/364R, 164C/353W/357C/364R, 196D/318K/324M/353N/357C/364K, 318K/343E/357, 318K/357M/364R, 324M/343E/357M, 324M/343E/357V/364K, 324M/357M/364R, 324N/353W/357C/364R, 339A/379D/389G/394E/395D, 339A/389G/395K, 339A/391*, 339A/394E/395K/405D, 357V/364R, 379D/386*, 379D/394E/395D/397A/404I/405H, 379D/394E/395K/397A/405D, 389G/394E/395D/397A/405D, or 394E/397A, wherein the amino acid positions are relative to the reference sequence corresponding to SEQ ID NO: 38. In some additional embodiments, the amino acid sequence of the engineered leucine decarboxylase polypeptide comprises at least a substitution or substitution set L48F/A64E/I164A/R324M/H343E/R353E/I357C/L364K, L48F/A64E/I164A/R324M/H343E/L364R, L48F/A64E/I164C/R353N/I357V/L364R, L48F/A64E/I357M/L364K, A64E/I164A/R324M/H343E/R353D/I357V/L364K, A64E/I164A/R324M/H343E/I357C/L364R, A64E/I164C/R353D/I357V, A64E/R318K/R324S/I357V/L364R, A64E/R324M/R353N/I357C/L364R, Y132F/H255P/Q339A/K379D/R395D, I164A/K196D/R324M/I357C/L364K, I164A/R318K/R324M/H343E/R353E/I357C, I164A/R324M/H343E/R353D/I357C/L364R, I164A/R324M/I357C/L364K, I164A/R353W/I357C/L364R, I164A/L364R, I164C/R318K/R324S/I357V/L364R, I164C/R324M/H343E/R353E/I357V/L364R, I164C/R353D/I357V/L364K, I164C/R353D/I357V/L364R, I164C/R353W/I357C/L364R, K196D/R318K/R324M/R353N/I357C/L364K, R318K/H343E/I357C, R318K/H343E/I357M, R324M/H343E/I357V/L364R, R324M/I357M/L364R, R324N/R353W/I357C/L364R, Q339A/K379D/K389G/K394E/R395D, Q339A/K389G/R395K, Q339A/A391*, Q339A/K394E/R395K/T405D, I357V/L364R, K379D/D386*, K379D/K394E/R395D/T397A/R404I/T405H, K379D/K394E/R395K/T397A/T405D, K389G/K394E/R395D/T397A/T405D, or K394E/T397A, wherein the amino acid positions are relative to the reference sequence corresponding to SEQ ID NO: 38.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 234, and wherein the amino acid sequence of said engineered leucine decarboxylase polypeptide comprises at least a substitution or substitution set at amino acid position 2, 3, 33, 48/64/255, 48/255/339, 48/255/379, 64, 64/255, 69, 161, 193, 255, 255/318/379, 259, 263, 318/339/379, 324, 324/389/394, 324/389/394/395, 324/389/394/397, 324/394, 324/394/395, 324/394/395/397, 324/395, 339, 340, 380, 382, 389, 389/394, 389/394/395, 389/394/395/397, 389/394/397, 389/395, 389/397, 390, 394, 394/395, 394/395/397, 395, 395/397, 397, 401, or 405, wherein the amino acid positions are relative to the reference sequence corresponding to SEQ ID NO: 234. In some additional embodiments, the amino acid sequence of said engineered leucine decarboxylase polypeptide comprises at least a substitution or substitution set 2E, 3M, 33L, 48F/64E/255P, 48F/255P/339A, 48F/255P/379D, 64E, 64E/255P, 64S, 69I, 161V, 193I, 255P, 255P/318K/379D, 259L, 263T, 263V, 318K/339A/379D, 324N, 324N/394E/395K/397A, 324N/395D, 324S/389G/394E, 324S/389G/394E/395D, 324S/389G/394E/397A, 324S/394E, 324S/394E/395K, 324S/394E/395K/397A, 324S/395K, 339A, 340T, 340V, 380E, 382S, 389G, 389G/394E, 389G/394E/395D, 389G/394E/395D/397A, 389G/394E/395K, 389G/394E/395K/397A, 389G/394E/397A, 389G/395D, 389G/395K, 389G/397A, 390*, 390A, 390E, 390S, 394E, 394E/395D, 394E/395K/397A, 395D/397A, 395K, 397A, 401*, 401Y, or 405H, wherein the amino acid positions are relative to the reference sequence corresponding to SEQ ID NO: 234. In some additional embodiments, the amino acid sequence of the engineered leucine decarboxylase polypeptide comprises at least a substitution or substitution set G2E, N3M, F33L, L48F/A64E/ H255P, L48F/H255P/Q339A, L48F/H255P/K379D, A64E, A64E/H255P, A64S, V69I, T161V, M193I, H255P, H255P/ R318K/K379D, R259L, S263T, S263V, R318K/Q339A/ K379D, M324N, M324N/K394E/R395K/T397A, M324N/ R395D, M324S/K389G/K394E, M324S/K389G/K394E/ R395D, M324S/K389G/K394E/T397A, M324S/K394E, M324S/K394E/R395K, M324S/K394E/R395K/T397A, M324S/R395K, Q339A, S340T, S340V, A380E, A382S, K389G, K389G/K394E, K389G/K394E/R395D, K389G/ K394E/R395D/T397A, K389G/K394E/R395K, K389G/ K394E/R395K/T397A, K389G/K394E/T397A, K389G/ R395D, K389G/R395K, K389G/T397A, P390*, P390A, P390E, P390S, K394E, K394E/R395D, K394E/R395K/ T397A, R395D/T397A, R395K, T397A, A401*, A401Y, or T405H, wherein the amino acid positions are relative to the reference sequence corresponding to SEQ ID NO: 234.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 284, and wherein the amino acid sequence of said engineered leucine decarboxylase polypeptide comprises at least a substitution or substitution set at amino acid position 2/64/69/324/380/382/388/389, 3/64/69/263/339/ 380/388, 3/64/69/389, 3/64/69/390, 3/64/379/380/390, 3/69/ 263/380, 3/69/324, 3/69/324/380/382/389/390, 12/135/259/ 263, 12/135/263/382, 12/259/263/304, 48/64/255, 64/69, 64/69/189/259/263/304, 64/69/189/259/263/304/339/340/ 379, 64/69/223/388, 64/69/223/388/389/390, 64/69/304/ 379/382, 64/69/324, 64/69/324/339/380/389/390, 64/69/ 339, 64/69/339/382/388/389, 64/69/339/389/390, 64/69/ 379/380, 64/69/380/388/390, 64/69/389, 64/69/390, 64/255/ 263, 64/263, 64/324/339/389/390, 69/223/263/324/382/388/ 390, 69/223/324/379/380/382/388/390, 69/263, 69/263/324, 69/263/339, 69/263/388, 69/263/389/390, 69/324/379/380/ 388, 69/324/380, 69/339/390, 69/382/390, 259/263/304, 259/263/304/339/340/379, 263/339/389/390, 263/390, or 304/340/379/380/382, wherein the amino acid positions are relative to the reference sequence corresponding to SEQ ID NO: 284. In some additional embodiments, the amino acid sequence of the engineered leucine decarboxylase polypeptide comprises at least a substitution or substitution set 2E/64S/69I/324S/380E/382S/388A/389G, 3M/64S/69I/ 263T/339A/380E/388A, 3M/64S/69I/389G, 3M/64S/69I/ 390*, 3M/64S/379D/380E/390*, 3M/69I/263T/380E, 3M/69I/324S, 3M/69I/324S/380E/382S/389G/390*, 12G/ 135V/259K/263T, 12G/135V/263T/382G, 12G/259K/263T/ 304R, 48L/64A/255H, 64A/255H/263T, 64S/69I, 64S/69I/ 189A/259Q/263T/304R/339A/340T/379N, 64S/69I/189D/ 259K/263T/304R, 64S/69I/223M/388A, 64S/69I/223M/ 388A/389G/390*, 64S/69I/304R/379E/382G, 64S/69I/ 324S, 64S/69I/324S/339A/380E/389G/390*, 64S/69I/ 339A, 64S/69I/339A/382S/388A/389G, 64S/69I/339A/ 389G/390*, 64S/69I/379D/380E, 64S/69I/380E/388A/ 390*, 64S/69I/389G, 64S/69I/390*, 64S/263T, 64S/324S/ 339A/389G/390*, 69I/223M/263T/324S/382S/388A/390*, 69I/223M/324S/379D/380E/382S/388A/390*, 69I/263T, 69I/263T/324S, 69I/263T/339A, 69I/263T/388A, 69I/263T/ 389G/390*, 69I/324S/379D/380E/388A, 69I/324S/380E, 69I/339A/390*, 69I/382S/390*, 259K/263T/304R, 259K/ 263T/304R/339A/340T/379N, 263T/339A/389G/390*, 263T/390*, or 304R/340T/379D/380E/382G, wherein the amino acid positions are relative to the reference sequence corresponding to SEQ ID NO: 284. In some additional embodiments, the amino acid sequence of the engineered leucine decarboxylase polypeptide comprises at least a substitution or substitution set G2E/E64S/V69I/M324S/A380E/ A382S/Q388A/K389G, N3M/E64S/V69I/S263T/Q339A/ A380E/Q388A, N3M/E64S/V69I/K389G, N3M/E64S/ V69I/P390*, N3M/E64S/K379D/A380E/P390*, N3M/ V69I/S263T/A380E, N3M/V69I/M324S, N3M/V69I/ M324S/A380E/A382S/K389G/P390*, S12G/L135V/ R259K/S263T, S12G/L135V/S263T/A382G, S12G/R259K/ S263T/A304R, F48L/E64A/P255H, E64A/P255H/S263T, E64S/V69I, E64S/V69I/T189A/R259Q/S263T/A304R/ Q339A/S340T/K379N, E64S/V69I/T189D/R259K/S263T/ A304R, E64S/V69I/A223M/Q388A, E64S/V69I/A223M/ Q388A/K389G/P390*, E64S/V69I/A304R/K379E/A382G, E64S/V69I/M324S, E64S/V69I/M324S/Q339A/A380E/ K389G/P390*, E64S/V69I/Q339A, E64S/V69I/Q339A/ A382S/Q388A/K389G, E64S/V69I/Q339A/K389G/P390*, E64S/V69I/K379D/A380E, E64S/V69I/A380E/Q388A/ P390*, E64S/V69I/K389G, E64S/V69I/P390*, E64S/ S263T, E64S/M324S/Q339A/K389G/P390*, V69I/A223M/ S263T/M324S/A382S/Q388A/P390*, V69I/A223M/ M324S/K379D/A380E/A382S/Q388A/P390*, V69I/S263T, V69I/S263T/M324S, V69I/S263T/Q339A, V69I/S263T/ Q388A, V69I/S263T/K389G/P390*, V69I/M324S/K379D/ A380E/Q388A, V69I/M324S/A380E, V69I/Q339A/P390*, V69I/A382S/P390*, R259K/S263T/A304R, R259K/S263T/ A304R/Q339A/S340T/K379N, S263T/Q339A/K389G/ P390*, S263T/P390*, or A304R/S340T/K379D/A380E/ A382G, wherein the amino acid positions are relative to the reference sequence corresponding to SEQ ID NO: 284.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO:484, and wherein the amino acid sequence of said engineered leucine decarboxylase polypeptide comprises at least a substitution or substitution set at amino acid position 3/194/304, 3/259/263/304, 3/259/304, 3/259/304/ 324/339, 3/259/304/324/382, 3/259/304/382, 3/263/304/ 324, 3/263/304/324/339, 3/263/304/324/382, 3/304, 3/304/ 324, 16, 63, 77, 80, 87/270, 87/270/365, 87/328/365, 91, 92, 126, 140, 156, 168/270/328/338, 181, 194, 201, 256, 259, 259/263, 259/263/304, 259/263/304/324, 259/263/304/324/ 382, 259/263/304/379, 259/263/304/382, 259/304, 259/304/ 324, 259/304/324/339, 259/304/324/339/382, 259/304/382, 262, 263/304, 263/304/324, 263/304/324/339, 263/304/324/ 382, 263/324, 270, 270/319, 270/328/338, 270/328/338/365, 304, 304/324, 324, 328, 352, 365, 366, or 382, wherein the amino acid positions are relative to the reference sequence corresponding to SEQ ID NO: 484. In some additional embodiments, the amino acid sequence of the engineered leucine decarboxylase polypeptide comprises at least a substitution or substitution set 3M/194L/304R, 3M/259K/263T/ 304R, 3M/259K/304R, 3M/259K/304R/324S/339A, 3M/259K/304R/324S/382S, 3M/259K/304R/382S, 3M/263T/304R/324S, 3M/263T/304R/324S/339A, 3M/263T/304R/324S/382S, 3M/304R, 3M/304R/324S, 16Q, 16V, 63C, 77L, 80G, 80K, 87R/270R, 87R/270R/ 365E, 87R/328N/365E, 91A, 91Q, 92K, 126A, 126T, 140V, 156A, 156S, 168K/270R/328N/338S, 181K, 181R, 181V, 194C, 194L, 201D, 256W, 259K, 259K/263T, 259K/263T/ 304R, 259K/263T/304R/324S, 259K/263T/304R/324S/ 382S, 259K/263T/304R/379D, 259K/263T/304R/382S, 259K/304R, 259K/304R/324S, 259K/304R/324S/339A, 259K/304R/324S/339A/382S, 259K/304R/382S, 262D, 262G, 262H, 262I, 262S, 262T, 263T/304R, 263T/304R/ 324S, 263T/304R/324S/339A, 263T/304R/324S/382S, 263T/324S, 270R, 270R/I319A, 270R/328N/338S, 270R/ 328N/338S/365E, 304R, 304R/324S, 324S, 328N, 352A, 365E, 366A, 366L, 366M, 366Q, 366T, 366V, or 382S, wherein the amino acid positions are relative to the reference sequence corresponding to SEQ ID NO: 484. In some additional embodiments, the amino acid sequence of the engineered leucine decarboxylase polypeptide comprises at least a substitution or substitution set N3M/F194L/A304R, N3M/R259K/S263T/A304R, N3M/R259K/A304R, N3M/ R259K/A304R/M324S/Q339A, N3M/R259K/A304R/ M324S/A382S, N3M/R259K/A304R/A382S, N3M/S263T/ A304R/M324S, N3M/S263T/A304R/M324S/Q339A, N3M/S263T/A304R/M324S/A382S, N3M/A304R, N3M/ A304R/M324S, R16Q, R16V, A63C, E77L, A80G, A80K, H87R/L270R, H87R/L270R/Q365E, H87R/C328N/Q365E, E91A, E91Q, E92K, D126A, D126T, M140V, G156A, G156S, C168K/L270R/C328N/P338S, T181K, T181R, T181V, F194C, F194L, E201D, Y256W, R259K, R259K/ S263T, R259K/S263T/A304R, R259K/S263T/A304R/ M324S, R259K/S263T/A304R/M324S/A382S, R259K/ S263T/A304R/K379D, R259K/S263T/A304R/A382S, R259K/A304R, R259K/A304R/M324S, R259K/A304R/ M324S/Q339A, R259K/A304R/M324S/Q339A/A382S, R259K/A304R/A382S, R262D, R262G, R262H, R262I, R262S, R262T, S263T/A304R, S263T/A304R/M324S, S263T/A304R/M324S/Q339A, S263T/A304R/M324S/ A382S, S263T/M324S, L270R, L270R/I319A, L270R/ C328N/P338S, L270R/C328N/P338S/Q365E, A304R, A304R/M324S, M324S, C328N, D352A, Q365E, H366A, H366L, H366M, H366Q, H366T, H366V, or A382S, wherein the amino acid positions are relative to the reference sequence corresponding to SEQ ID NO: 484.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 594, and wherein the amino acid sequence of said engineered leucine decarboxylase polypeptide comprises at least a substitution or substitution set at amino acid position 16/63/80/126/168/366, 16/63/80/126/181/194/259/ 324/328/366, 16/63/126/168/270/328/366, 16/80/126/324/ 366, 16/80/126/366, 16/80/168, 16/80/168/270/366, 16/80/ 168/324, 16/80/168/366, 16/80/324, 16/91/126/168/324/ 366, 16/126/168/366, 16/168/259/366, 16/168/270/324/366, 16/168/324/328/366, 16/168/324/366, 16/168/366, 16/259/ 263/328, 16/324/328/366, 16/328/366, 80/126/168/270/366, 80/126/168/366, 80/126/181/270/324/366, 80/168/270/366, or 168/366, wherein the amino acid positions are relative to the reference sequence corresponding to SEQ ID NO: 594. In some additional embodiments, the amino acid sequence of the engineered leucine decarboxylase polypeptide comprises at least a substitution or substitution set 16Q/63C/ 80K/126T/168K/366M, 16Q/63C/80K/126T/181R/194C/ 259K/324S/328N/366M, 16Q/63C/126T/168K/270R/328N/ 366M, 16Q/80K/126T/324S/366M, 16Q/80K/126T/366M, 16Q/80K/168K, 16Q/80K/168K/270R/366M, 16Q/80K/ 168K/324S, 16Q/80K/168K/366M, 16Q/80K/324S, 16Q/ 91A/126T/168K/324S/366M, 16Q/126T/168K/366M, 16Q/ 168K/259K/366M, 16Q/168K/270R/324S/366M, 16Q/ 168K/324S/328N/366M, 16Q/168K/324S/366M, 16Q/ 168K/366M, 16Q/259K/263T/328N, 16Q/324S/328N/ 366M, 16Q/328N/366M, 80K/126T/168K/270R/366M, 80K/126T/168K/366M, 80K/126T/181R/270R/324S/366M, 80K/168K/270R/366M, or 168K/366M, wherein the amino acid positions are relative to the reference sequence corresponding to SEQ ID NO: 594. In some additional embodiments, the amino acid sequence of the engineered leucine decarboxylase polypeptide comprises at least a substitution or substitution set R16Q/A63C/A80K/D126T/C168K/ H366M, R16Q/A63C/A80K/D126T/T181R/F194C/R259K/ M324S/C328N/H366M, R16Q/A63C/D126T/C168K/ L270R/C328N/H366M, R16Q/A80K/D126T/M324S/ H366M, R16Q/A80K/D126T/H366M, R16Q/A80K/ C168K, R16Q/A80K/C168K/L270R/H366M, R16Q/A80K/ C168K/M324S, R16Q/A80K/C168K/H366M, R16Q/ A80K/M324S, R16Q/E91A/D126T/C168K/M324S/ H366M, R16Q/D126T/C168K/H366M, R16Q/C168K/ R259K/H366M, R16Q/C168K/L270R/M324S/H366M, R16Q/C168K/M324S/C328N/H366M, R16Q/C168K/ M324S/H366M, R16Q/C168K/H366M, R16Q/R259K/ S263T/C328N, R16Q/M324S/C328N/H366M, R16Q/ C328N/H366M, A80K/D126T/C168K/L270R/H366M, A80K/D126T/C168K/H366M, A80K/D126T/T181R/ L270R/M324S/H366M, A80K/C168K/L270R/H366M, or C168K/H366M, wherein the amino acid positions are relative to the reference sequence corresponding to SEQ ID NO: 594.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO:686, and wherein the amino acid sequence of said engineered leucine decarboxylase polypeptide comprises at least a substitution or substitution set at amino acid position 66/76/118/141/201/300, 66/76/198/200/296/303, 66/76/198/200/300, 66/118/200/296/303/317, 66/118/296, 66/118/296/300, 66/200, 76/118/141/200/296, 76/141/198/ 200/201/300, 80/201/270, 80/270, 80/270/324, 89/118/200, 106/270/324/352, 118/141/200, 126, 126/201/270/324, 126/ 270, 141/144/198/200/300, 156/270, 156/270/324, 201/270, 201/270/352, 270, or 270/324, wherein the amino acid positions are relative to the reference sequence corresponding to SEQ ID NO: 686. In some additional embodiments, the amino acid sequence of the engineered leucine decarboxylase polypeptide comprises at least a substitution or substitution set 66N/76V/118D/141P/201R/300K, 66N/ 76V/198G/200S/296E/303Q, 66N/76V/198G/200S/300K, 66N/118D/200S/296E/303Q/317Q, 66N/118D/296E, 66N/ 118D/296E/300K, 66N/200S, 76V/118D/141P/200S/296E, 76V/141P/198G/200S/201R/300K, 80K/201D/270R, 80K/ 270R, 80K/270R/324S, 89P/118D/200S, 106M/270R/324S/ 352A, 118D/141P/200S, 126T, 126T/201D/270R/324S, 126T/270R, 141P/144V/198G/200S/300K, 156A/270R, 156A/270R/324S, 201D/270R, 201D/270R/352A, 270R, or 270R/324S, wherein the amino acid positions are relative to the reference sequence corresponding to SEQ ID NO: 686. In some additional embodiments, the amino acid sequence of the engineered leucine decarboxylase polypeptide comprises at least a substitution or substitution set S66N/R76V/ T118D/R141P/E201R/K300K, S66N/R76V/A198G/H200S/ D296E/A303Q, S66N/R76V/A198G/H200S/R300K, S66N/ T118D/H200S/D296E/A303Q/K317Q, S66N/T118D/ D296E, S66N/T118D/D296E/R300K, S66N/H200S, R76V/ T118D/R141P/H200S/D296E, R76V/R141P/A198G/ H200S/E201R/R300K, A80K/E201D/L270R, A80K/ L270R, A80K/L270R/M324S, A89P/T118D/H200S, L106M/L270R/M324S/D352A, T118D/R141P/H200S, D126T, D126T/E201D/L270R/M324S, D126T/L270R, R141P/M144V/A198G/H200S/R300K, G156A/L270R, G156A/L270R/M324S, E201D/L270R, E201D/L270R/

D352A, L270R, or L270R/M324S, wherein the amino acid positions are relative to the reference sequence corresponding to SEQ ID NO: 686.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO:686, and wherein the amino acid sequence of said engineered leucine decarboxylase polypeptide comprises at least a substitution or substitution set at amino acid position 19, 109, 123, 134, 170, 173, 187, 211, or 312, wherein the amino acid positions are relative to the reference sequence corresponding to SEQ ID NO: 686. In some additional embodiments, the amino acid sequence of said engineered leucine decarboxylase polypeptide comprises at least a substitution or substitution set 19I, 109G, 123F, 123M, 123V, 134A, 134S, 170A, 173A, 173I, 173T, 187L, 211S, or 312A, wherein the amino acid positions are relative to the reference sequence corresponding to SEQ ID NO: 686. In some additional embodiments, the amino acid sequence of the engineered leucine decarboxylase polypeptide comprises at least a substitution or substitution set L19I, L109G, Y123F, Y123M, Y123V, N134A, N134S, P170A, F173A, F173I, F173T, V187L, A211S, or T312A, wherein the amino acid positions are relative to the reference sequence corresponding to SEQ ID NO: 686.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 688, and wherein the amino acid sequence of said engineered leucine decarboxylase polypeptide comprises at least a substitution or substitution set at amino acid position 19/109/123/141/170/198/200/211/270/312, 19/109/123/141/170/198/211, 19/109/123/141/170/198/211/270/312, 19/109/123/170/211/270/312, 19/109/123/198/200/211/270/312, 19/109/170/173/211/270/312, 19/109/211/270/312, 109/170/211/270/312, or 109/211/270/312, wherein the amino acid positions are relative to the reference sequence corresponding to SEQ ID NO: 688. In some additional embodiments, the amino acid sequence of the engineered leucine decarboxylase polypeptide comprises at least a substitution or substitution set 19I/109G/123F/170A/211S/270R/312A, 19I/109G/123F/198G/200S/211S/270R/312A, 19I/109G/123V/141P/170A/198G/200S/211S/270R/312A, 19I/109G/123V/141P/170A/198G/211S, 19I/109G/123V/141P/170A/198G/211S/270R/312A, 19I/109G/170A/173I/211S/270R/312A, 19I/109G/211S/270R/312A, 109G/170A/211S/270R/312A, or 109G/211S/270R/312A, wherein the amino acid positions are relative to the reference sequence corresponding to SEQ ID NO: 688. In some additional embodiments, the amino acid sequence of the engineered leucine decarboxylase polypeptide comprises at least a substitution or substitution set L19I/L109G/Y123F/P170A/A211S/L270R/T312A, L19I/L109G/Y123F/A198G/H200S/A211S/L270R/T312A, L19I/L109G/Y123V/R141P/P170A/A198G/H200S/A211S/L270R/T312A, L19I/L109G/Y123V/R141P/P170A/A198G/A211S, L19I/L109G/Y123V/R141P/P170A/A198G/A211S/L270R/T312A, L19I/L109G/P170A/F173I/A211S/L270R/T312A, L19I/L109G/A211S/L270R/T312A, L109G/P170A/A211S/L270R/T312A, or L109G/A211S/L270R/T312A, wherein the amino acid positions are relative to the reference sequence corresponding to SEQ ID NO: 688.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 766, and wherein the amino acid sequence of said engineered leucine decarboxylase polypeptide comprises at least a substitution or substitution set at amino acid position 5/41, 5/41/228, 33, 41, 47, 51, 55, 64, 126, 265, 267, 270, 331, 353, 357, or 384, wherein the amino acid positions are relative to the reference sequence corresponding to SEQ ID NO: 766. In some additional embodiments, the amino acid sequence of the engineered leucine decarboxylase polypeptide comprises at least a substitution or substitution set 5V/41D, 5V/41D/228D, 33L, 41D, 47F, 51E, 51Q, 55I, 64N, 126A, 126T, 265P, 267L, 270A, 270T, 331V, 353E, 353I, 353L, 357S, or 384W, wherein the amino acid positions are relative to the reference sequence corresponding to SEQ ID NO: 766. In some additional embodiments, the amino acid sequence of the engineered leucine decarboxylase polypeptide comprises at least a substitution or substitution set K5V/H41D, K5V/H41D/T228D, F33L, H41D, L47F, L51E, L51Q, V55I, S64N, D126A, D126T, E265P, I267L, R270A, R270T, T331V, D353E, D353I, D353L, C357S, or P384W, wherein the amino acid positions are relative to the reference sequence corresponding to SEQ ID NO: 766.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to SEQ ID NO: 766, and wherein the amino acid sequence of said engineered leucine decarboxylase polypeptide comprises at least a substitution or substitution set at amino acid position 66, 66/118, 66/118/296, 66/118/296/300, 66/118/300, 66/296, 66/296/300, 66/300, 118, 118/296, 118/296/300, 118/300, 296, 296/300, or 300, wherein the amino acid positions are relative to the reference sequence corresponding to SEQ ID NO: 766. In some additional embodiments, the amino acid sequence of said engineered leucine decarboxylase polypeptide comprises at least a substitution or substitution set 66S, 66S/118T, 66S/118T/296D, 66S/118T/296D/300R, 66S/118T/300R, 66S/296D, 66S/296D/300R, 66S/300R, 118T, 118T/296D, 118T/296D/300R, 118T/300R, 296D, 296D/300R, or 300R, wherein the amino acid positions are relative to the reference sequence corresponding to SEQ ID NO: 766. In some additional embodiments, the amino acid sequence of said engineered leucine decarboxylase polypeptide comprises at least a substitution or substitution set N66S, N66S/D118T, N66S/D118T/E296D, N66S/D118T/E296D/K300R, N66S/D118T/K300R, N66S/E296D, N66S/E296D/K300R, N66S/K300R, D118T, D118T/E296D, D118T/E296D/K300R, D118T/K300R, E296D, E296D/K300R, or K300R, wherein the amino acid positions are relative to the reference sequence corresponding to SEQ ID NO: 766.

In some embodiments, the engineered leucine decarboxylase polypeptide comprises an amino acid sequence having at least a substitution or substitution set at amino acid position 5, 14, 14/34/38/39/102/267/275/350/357, 14/39/102/127/245/267/275/349/350, 34/38/39/102/127/275/357, 34/38/39/102/275/357, 34/38/39/127/245/349/350/357, 34/38/39/127/245/350/357, 34/39/102/127/264/275/357, 34/39/102/127/275/349/357, 34/39/102/264/275/350/357, 34/39/275/349/350/357, 38/39/102/127/264/267/350/357, 38/39/102/127/267/275/349/350/357, 38/39/102/127/349/350/357, 38/39/102/127/350, 38/39/102/127/350/357, 38/39/127/245/267/357, 38/39/127/264/275, 38/39/127/264/350/357, 38/39/127/350/357, 38/39/127/357, 38/39/245/275/357, 38/39/264/267/275/350, 38/39/264/275/357, 38/39/275, 38/39/275/350, 39, 39/102/127/264/275/357, 39/102/264/275/357, 39/102/267/275/357, 39/127/245/264/ 267/275/350, 39/127/245/264/275/350/357, 39/127/245/ 357, 39/127/267/275/350/357, 39/127/267/350/357, 39/127/ 357, 39/245/264/267/275/357, 39/264/267/275/350, 39/275/ 350/357, 48, 139, 164, 196, 255, 299, 318, 324, 339, 343, 350, 353, 357, 364, 365, 379, 381, 386, 389, 391, 393, 394, 395, 397, 398, or 405, wherein the amino acid positions are relative to the reference sequence corresponding to SEQ ID NO: 12. In some additional embodiments, the amino acid sequence of said engineered leucine decarboxylase polypeptide comprises at least a substitution or substitution set 5M, 14I, 14T/34L/38V/39N/102S/267I/275S/350E/357V, 14T/ 39N/102S/127S/245M/267I/275S/349T/350E, 34L/38V/ 39N/102S/127S/275S/357V, 34L/38V/39N/102S/275S/ 357V, 34L/38V/39N/127S/245M/349T/350E/357V, 34L/ 38V/39N/127S/245M/350E/357V, 34L/39N/102S/127S/ 264V/275S/357V, 34L/39N/102S/127S/275S/349T/357V, 34L/39N/102S/264V/275S/350E/357V, 34L/39N/275S/ 349T/350E/357V, 38V/39N/102S/127S/264V/267I/350E/ 357V, 38V/39N/102S/127S/267I/275S/349T/350E/357V, 38V/39N/102S/127S/349T/350E/357V, 38V/39N/102S/ 127S/350E, 38V/39N/102S/127S/350E/357V, 38V/39N/ 127S/245M/267I/357V, 38V/39N/127S/264V/275S, 38V/ 39N/127S/264V/350E/357V, 38V/39N/127S/350E/357V, 38V/39N/127S/357V, 38V/39N/245M/275S/357V, 38V/ 39N/264V/267I/275S/350E, 38V/39N/264V/275S/357V, 38V/39N/275S, 38V/39N/275S/350E, 39N/102S/127S/ 264V/275S/357V, 39N/102S/264V/275S/357V, 39N/102S/ 267I/275S/357V, 39N/127S/245M/264V/267I/275S/350E, 39N/127S/245M/264V/275S/350E/357V, 39N/127S/245M/ 357V, 39N/127S/267I/275S/350E/357V, 39N/127S/267I/ 350E/357V, 39N/127S/357V, 39N/245M/264V/267I/275S/ 357V, 39N/264V/267I/275S/350E, 39N/275S/350E/357V, 39S, 48F, 139G, 164A, 164C, 196D, 196R, 255G, 255N, 255P, 299A, 299V, 318K, 324M, 324S, 324T, 339A, 339D, 343A, 343E, 350S, 353D, 353E, 353L, 353N, 353S, 353W, 357C, 357M, 364K, 364R, 365E, 379D, 379P, 381D, 381E, 386*, 389E, 389G, 389P, 389Q, 391*, 391E, 393T, 394E, 395A, 395D, 395G, 395K, 395S, 397A, 398*, 405D, 405E, 405H, or 405L, wherein the amino acid positions are relative to the reference sequence corresponding to SEQ ID NO: 12. In some additional embodiments, the amino acid sequence of said engineered leucine decarboxylase polypeptide comprises at least a substitution or substitution set K5M, H14I, H14T/I34L/C38V/T39N/T102S/V267I/T275S/N350E/ I357V, H14T/T39N/T102S/T127S/I245M/V267I/T275S/ V349T/N350E, I34L/C38V/T39N/T102S/T127S/T275S/ I357V, I34L/C38V/T39N/T102S/T275S/I357V, I34L/ C38V/T39N/T127S/I245M/V349T/N350E/I357V, I34L/ C38V/T39N/T127S/I245M/N350E/I357V, I34L/T39N/ T102S/T127S/I264V/T275S/I357V, I34L/T39N/T102S/ T127S/T275S/V349T/I357V, I34L/T39N/T102S/I264V/ T275S/N350E/I357V, I34L/T39N/T275S/V349T/N350E/ I357V, C38V/T39N/T102S/T127S/I264V/V267I/N350E/ I357V, C38V/T39N/T102S/T127S/V267I/T275S/V349T/ N350E/I357V, C38V/T39N/T102S/T127S/V349T/N350E/ I357V, C38V/T39N/T102S/T127S/N350E, C38V/T39N/ T102S/T127S/N350E/I357V, C38V/T39N/T127S/I245M/ V267I/I357V, C38V/T39N/T127S/I264V/T275S, C38V/ T39N/T127S/I264V/N350E/I357V, C38V/T39N/T127S/ N350E/I357V, C38V/T39N/T127S/I357V, C38V/T39N/ I245M/T275S/I357V, C38V/T39N/I264V/V267I/T275S/ N350E, C38V/T39N/I264V/T275S/I357V, C38V/T39N/ T275S, C38V/T39N/T275S/N350E, T39N/T102S/T127S/ I264V/T275S/I357V, T39N/T102S/I264V/T275S/I357V, T39N/T102S/V267I/T275S/I357V, T39N/T127S/I245M/ I264V/V267I/T275S/N350E, T39N/T127S/I245M/I264V/ T275S/N350E/I357V, T39N/T127S/I245M/I357V, T39N/ T127S/V267I/T275S/N350E/I357V, T39N/T127S/V267I/ N350E/I357V, T39N/T127S/I357V, T39N/I245M/I264V/ V267I/T275S/I357V, T39N/I264V/V267I/T275S/N350E, T39N/T275S/N350E/I357V, T39S, L48F, N139G, I164A, I164C, K196D, K196R, H255G, H255N, H255P, K299A, K299V, R318K, R324M, R324S, R324T, Q339A, Q339D, H343A, H343E, N350S, R353D, R353E, R353L, R353N, R353S, R353W, I357C, I357M, L364K, L364R, Q365E, K379D, K379P, A381D, A381E, D386*, K389E, K389G, K389P, K389Q, A391*, A391E, K393T, K394E, R395A, R395D, R395G, R395K, R395S, T397A, P398*, T405D, T405E, T405H, or T405L, wherein the amino acid positions are relative to the reference sequence corresponding to SEQ ID NO: 12.

In some additional embodiments, the amino acid sequence of said engineered leucine decarboxylase polypeptide comprises at least a substitution or substitution set at amino acid position 48/64/164/324/343/353/357/364, 48/64/ 164/324/343/364, 48/64/164/353/357/364, 48/64/357/364, 64/164/324/343/353/357/364, 64/164/324/343/357/364, 64/164/324/353/357, 64/318/324/357/364, 64/324/353/357/364, 132/255/339/379/395, 164/196/324/357/364, 164/318/324/ 343/353/357, 164/318/324/357/364, 164/324/343/353/357/ 364, 164/324/357/364, 164/353/357/364, 164/364, 196/318/ 324/353/357/364, 318/343/357, 324/343/357/364, 324/353/ 357/364, 324/357/364, 339/379/389/394/395, 339/389/395, 339/391, 339/394/395/405, 357/364, 379/386, 379/394/395/ 397/404/405, 379/394/395/397/405, 389/394/395/397/405, or 394/397, wherein the amino acid positions are relative to the reference sequence corresponding to SEQ ID NO: 38. In some additional embodiments, the amino acid sequence of said engineered leucine decarboxylase polypeptide comprises at least a substitution or substitution set 48F/64E/ 164A/324M/343E/353E/357C/364K, 48F/64E/164A/324M/ 343E/364R, 48F/64E/164C/353N/357V/364R, 48F/64E/ 357M/364K, 64E/164A/324M/343E/353D/357V/364K, 64E/164A/324M/343E/357C/364R, 64E/164C/353D/357V, 64E/318K/324S/357V/364R, 64E/324M/353N/357C/364R, 132F/255P/339A/379D/395D, 164A/196D/324M/357C/ 364K, 164A/318K/324M/343E/353E/357C, 164A/324M/ 343E/353D/357C/364R, 164A/324M/357C/364K, 164A/ 353W/357C/364R, 164A/364R, 164C/318K/324S/357V/ 364R, 164C/324M/343E/353D/357V/364R, 164C/353D/ 357V/364K, 164C/353D/357V/364R, 164C/353W/357C/ 364R, 196D/318K/324M/353N/357C/364R, 318K/343E/ 357C, 318K/343E/357M, 324M/343E/357V/364K, 324M/ 357M/364R, 324N/353W/357C/364K, 339A/379D/389G/ 394E/395D, 339A/389G/395K, 339A/391*, 339A/394E/ 395K/405D, 357V/364R, 379D/386*, 379D/394E/395D/ 397A/404I/405H, 379D/394E/395K/397A/405D, 389G/ 394E/395D/397A/405D, or 394E/397A, wherein the amino acid positions are relative to the reference sequence corresponding to SEQ ID NO: 38. In some additional embodiments, the amino acid sequence of said engineered leucine decarboxylase polypeptide comprises at least a substitution or substitution set L48F/A64E/I164A/R324M/H343E/ R353E/I357C/L364K, L48F/A64E/I164A/R324M/H343E/ L364R, L48F/A64E/I164C/R353N/I357V/L364R, L48F/ A64E/I357M/L364K, A64E/I164A/R324M/H343E/R353D/ I357V/L364K, A64E/I164A/R324M/H343E/I357C/L364R, A64E/I164C/R353D/I357V, A64E/R318K/R324S/I357V/ L364R, A64E/R324M/R353N/I357C/L364R, Y132F/ H255P/Q339A/K379D/R395D, I164A/K196D/R324M/ I357C/L364K, I164A/R318K/R324M/H343E/R353E/ I357C, I164A/R324M/H343E/R353D/I357C/L364R, I164A/R324M/I357C/L364K, I164A/R353W/I357C/

L364R, I164A/L364R, I164C/R318K/R324S/I357V/L364R, I164C/R324M/H343E/R353D/I357V/L364R, I164C/R353D/I357V/L364K, I164C/R353W/I357V/L364R, I164C/R353W/I357V/L364R, K196D/R318K/R324M/R353N/I357C/L364K, R318K/H343E/I357C, R318K/H343E/I357M, R324M/H343E/I357V/L364K, R324M/I357M/L364R, R324N/R353W/I357C/L364K, Q339A/K379D/K389G/K394E/R395D, Q339A/K389G/R395K, Q339A/A391*, Q339A/K394E/R395K/T405D, I357V/L364R, K379D/D386*, K379D/K394E/R395D/T397A/R404I/T405H, K379D/K394E/R395K/T397A/T405D, K389G/K394E/R395D/T397A/T405D, or K394E/T397A, wherein the amino acid positions are relative to the reference sequence corresponding to SEQ ID NO: 38.

In some additional embodiments, the amino acid sequence of said engineered leucine decarboxylase polypeptide comprises at least a substitution or substitution set at amino acid position 2, 3, 33, 48/64/255, 48/255/339, 48/255/379, 64, 64/255, 69, 161, 193, 255, 255/318/379, 259, 263, 318/339/379, 324, 324/389/394, 324/389/394/395, 324/389/394/397, 324/394, 324/394/395, 324/394/395/397, 324/395, 339, 340, 380, 382, 389, 389/394, 389/394/395, 389/394/395/397, 389/394/397, 389/395, 389/397, 390, 394, 394/395, 394/395/397, 395, 395/397, 397, 401, or 405, wherein the amino acid positions are relative to the reference sequence corresponding to SEQ ID NO: 234. In some additional embodiments, the amino acid sequence of said engineered leucine decarboxylase polypeptide comprises at least a substitution or substitution set 2E, 3M, 33L, 48F/64E/255P, 48F/255P/339A, 48F/255P/379D, 64E, 64E/255P, 64S, 69I, 161V, 193I, 255P, 255P/318K/379D, 259L, 263T, 263V, 318K/339A/379D, 324N, 324N/394E/395K/397A, 324N/395D, 324S/389G/394E, 324S/389G/394E/395D, 324S/389G/394E/397A, 324S/394E, 324S/394E/395K, 324S/394E/395K/397A, 324S/395K, 339A, 340T, 340V, 380E, 382S, 389G, 389G/394E, 389G/394E/395D, 389G/394E/395D/397A, 389G/394E/395K, 389G/394E/395K/397A, 389G/394E/397A, 389G/395D, 389G/395K, 389G/397A, 390*, 390A, 390E, 390S, 394E, 394E/395D, 394E/395K/397A, 395D/397A, 395K, 397A, 401*, 401Y, or 405H, wherein the amino acid positions are relative to the reference sequence corresponding to SEQ ID NO: 234. In some additional embodiments, the amino acid sequence of said engineered leucine decarboxylase polypeptide comprises at least a substitution or substitution set G2E, N3M, F33L, L48F/A64E/H255P, L48F/H255P/Q339A, L48F/H255P/K379D, A64E, A64E/H255P, A64S, V69I, T161V, M193I, H255P, H255P/R318K/K379D, R259L, S263T, S263V, R318K/Q339A/K379D, M324N, M324N/K394E/R395K/T397A, M324N/R395D, M324S/K389G/K394E, M324S/K389G/K394E/R395D, M324S/K389G/K394E/T397A, M324S/K394E, M324S/K394E/R395K, M324S/K394E/R395K/T397A, M324S/R395K, Q339A, S340T, S340V, A380E, A382S, K389G, K389G/K394E, K389G/K394E/R395D, K389G/K394E/R395D/T397A, K389G/K394E/R395K, K389G/K394E/R395K/T397A, K389G/K394E/T397A, K389G/R395D, K389G/R395K, K389G/T397A, P390*, P390A, P390E, P390S, K394E, K394E/R395D, K394E/R395K/T397A, R395D/T397A, R395K, T397A, A401*, A401Y, or T405H, wherein the amino acid positions are relative to the reference sequence corresponding to SEQ ID NO: 234.

In some additional embodiments, the amino acid sequence of said engineered leucine decarboxylase polypeptide comprises at least a substitution or substitution set at amino acid position 2/64/69/324/380/382/388/389, 3/64/69/263/339/380/388, 3/64/69/389, 3/64/69/390, 3/64/379/380/390, 3/69/263/380, 3/69/324, 3/69/324/380/382/389/390, 12/135/259/263, 12/135/263/382, 12/259/263/304, 48/64/255, 64/69, 64/69/189/259/263/304, 64/69/189/259/263/304/339/340/379, 64/69/223/388, 64/69/223/388/389/390, 64/69/304/379/382, 64/69/324, 64/69/324/339/380/389/390, 64/69/339, 64/69/339/382/388/389, 64/69/339/389/390, 64/69/379/380, 64/69/380/388/390, 64/69/389, 64/69/390, 64/255/263, 64/263, 64/324/339/389/390, 69/223/263/324/382/388/390, 69/223/324/379/380/382/388/390, 69/263, 69/263/324, 69/263/339, 69/263/388, 69/263/389/390, 69/324/379/380/388, 69/324/380, 69/339/390, 69/382/390, 259/263/304, 259/263/304/339/340/379, 263/339/389/390, 263/390, or 304/340/379/380/382, wherein the amino acid positions are relative to the reference sequence corresponding to SEQ ID NO: 284. In some additional embodiments, the amino acid sequence of said engineered leucine decarboxylase polypeptide comprises at least a substitution or substitution set 2E/64S/69I/324S/380E/382S/388A/389G, 3M/64S/69I/263T/339A/380E/388A, 3M/64S/69I/389G, 3M/64S/69I/390*, 3M/64S/379D/380E/390*, 3M/69I/263T/380E, 3M/69I/324S, 3M/69I/324S/380E/382S/389G/390*, 12G/135V/259K/263T, 12G/135V/263T/382G, 12G/259K/263T/304R, 48L/64A/255H, 64A/255H/263T, 64S/69I, 64S/69I/189A/259Q/263T/304R/339A/340T/379N, 64S/69I/189D/259K/263T/304R, 64S/69I/223M/388A, 64S/69I/223M/388A/389G/390*, 64S/69I/304R/379E/382G, 64S/69I/324S, 64S/69I/324S/339A/380E/389G/390*, 64S/69I/339A, 64S/69I/339A/382S/388A/389G, 64S/69I/339A/389G/390*, 64S/69I/379D/380E, 64S/69I/380E/388A/390*, 64S/69I/389G, 64S/69I/390*, 64S/263T, 64S/324S/339A/389G/390*, 69I/223M/263T/324S/382S/388A/390*, 69I/223M/324S/379D/380E/382S/388A/390*, 69I/263T, 69I/263T/324S, 69I/263T/339A, 69I/263T/388A, 69I/263T/389G/390*, 69I/324S/379D/380E/388A, 69I/324S/380E, 69I/339A/390*, 69I/382S/390*, 259K/263T/304R, 259K/263T/304R/339A/340T/379N, 263T/339A/389G/390*, 263T/390*, or 304R/340T/379D/380E/382G, wherein the amino acid positions are relative to the reference sequence corresponding to SEQ ID NO: 284. In some additional embodiments, the amino acid sequence of said engineered leucine decarboxylase polypeptide comprises at least a substitution or substitution set G2E/E64S/V69I/M324S/A380E/A382S/Q388A/K389G, N3M/E64S/V69I/S263T/Q339A/A380E/Q388A, N3M/E64S/V69I/K389G, N3M/E64S/V69I/P390*, N3M/E64S/K379D/A380E/P390*, N3M/V69I/S263T/A380E, N3M/V69I/M324S, N3M/V69I/M324S/A380E/A382S/K389G/P390*, S12G/L135V/R259K/S263T, S12G/L135V/S263T/A382G, S12G/R259K/S263T/A304R, F48L/E64A/P255H, E64A/P255H/S263T, E64S/V69I, E64S/V69I/T189A/R259Q/S263T/A304R/Q339A/S340T/K379N, E64S/V69I/T189D/R259K/S263T/A304R, E64S/V69I/A223M/Q388A, E64S/V69I/A223M/Q388A/K389G/P390*, E64S/V69I/A304R/K379E/A382G, E64S/V69I/M324S, E64S/V69I/M324S/Q339A/A380E/K389G/P390*, E64S/V69I/Q339A, E64S/V69I/Q339A/A382S/Q388A/K389G, E64S/V69I/Q339A/K389G/P390*, E64S/V69I/K379D/A380E, E64S/V69I/A380E/Q388A/P390*, E64S/V69I/K389G, E64S/V69I/P390*, E64S/S263T, E64S/M324S/Q339A/K389G/P390*, V69I/A223M/S263T/M324S/A382S/Q388A/P390*, V69I/A223M/M324S/K379D/A380E/A382S/Q388A/P390*, V69I/S263T, V69I/S263T/M324S, V69I/S263T/Q339A, V69I/S263T/Q388A, V69I/S263T/K389G/P390*, V69I/M324S/K379D/A380E/Q388A, V69I/M324S/A380E, V69I/Q339A/P390*, V69I/A382S/P390*, R259K/S263T/A304R, R259K/S263T/A304R/Q339A/S340T/K379N, S263T/Q339A/K389G/P390*, S263T/P390*, or A304R/

S340T/K379D/A380E/A382G, wherein the amino acid positions are relative to the reference sequence corresponding to SEQ ID NO: 284.

In some additional embodiments, the amino acid sequence of said engineered leucine decarboxylase polypeptide comprises at least a substitution or substitution set at amino acid position 3/194/304, 3/259/263/304, 3/259/304, 3/259/304/324/339, 3/259/304/324/382, 3/259/304/382, 3/263/304/324, 3/263/304/324/339, 3/263/304/324/382, 3/304, 3/304/324, 16, 63, 77, 80, 87/270, 87/270/365, 87/328/365, 91, 92, 126, 140, 156, 168/270/328/338, 181, 194, 201, 256, 259, 259/263, 259/263/304, 259/263/304/ 324, 259/263/304/324/382, 259/263/304/379, 259/263/304/ 382, 259/304, 259/304/324, 259/304/324/339, 259/304/324/ 339/382, 259/304/382, 262, 263/304, 263/304/324, 263/304/ 324/339, 263/304/324/382, 263/324, 270, 270/319, 270/328/ 338, 270/328/338/365, 304, 304/324, 324, 328, 352, 365, 366, or 382, wherein the amino acid positions are relative to the reference sequence corresponding to SEQ ID NO: 484. In some additional embodiments, the amino acid sequence of said engineered leucine decarboxylase polypeptide comprises at least a substitution or substitution set 3M/194L/ 304R, 3M/259K/263T/304R, 3M/259K/304R, 3M/259K/ 304R/324S/339A, 3M/259K/304R/324S/382S, 3M/259K/ 304R/382S, 3M/263T/304R/324S, 3M/263T/304R/324S/ 339A, 3M/263T/304R/324S/382S, 3M/304R, 3M/304R/ 324S, 16Q, 16V, 63C, 77L, 80G, 80K, 87R/270R, 87R/ 270R/365E, 87R/328N/365E, 91A, 91Q, 92K, 126A, 126T, 140V, 156A, 156S, 168K/270R/328N/338S, 181K, 181R, 181V, 194C, 194L, 201D, 256W, 259K, 259K/263T, 259K/ 263T/304R, 259K/263T/304R/324S, 259K/263T/304R/ 324S/382S, 259K/263T/304R/379D, 259K/263T/304R/ 382S, 259K/304R, 259K/304R/324S, 259K/304R/324S/ 339A, 259K/304R/324S/339A/382S, 259K/304R/382S, 262D, 262G, 262H, 262I, 262S, 262T, 263T/304R, 263T/ 304R/324S, 263T/304R/324S/339A, 263T/304R/324S/ 382S, 263T/324S, 270R, 270R/319A, 270R/328N/338S, 270R/328N/338S/365E, 304R, 304R/324S, 324S, 328N, 352A, 365E, 366A, 366L, 366M, 366Q, 366T, 366V, or 382S, wherein the amino acid positions are relative to the reference sequence corresponding to SEQ ID NO: 484. In some additional embodiments, the amino acid sequence of said engineered leucine decarboxylase polypeptide comprises at least a substitution or substitution set N3M/F194L/ A304R, N3M/R259K/S263T/A304R, N3M/R259K/A304R, N3M/R259K/A304R/M324S/Q339A, N3M/R259K/ A304R/M324S/A382S, N3M/R259K/A304R/A382S, N3M/ S263T/A304R/M324S, N3M/S263T/A304R/M324S/ Q339A, N3M/S263T/A304R/M324S/A382S, N3M/A304R, N3M/A304R/M324S, R16Q, R16V, A63C, E77L, A80G, A80K, H87R/L270R, H87R/L270R/Q365E, H87R/C328N/ Q365E, E91A, E91Q, E92K, D126A, D126T, M140V, G156A, G156S, C168K/L270R/C328N/P338S, T181K, T181R, T181V, F194C, F194L, E201D, Y256W, R259K, R259K/S263T, R259K/S263T/A304R, R259K/S263T/ A304R/M324S, R259K/S263T/A304R/M324S/A382S, R259K/S263T/A304R/K379D, R259K/S263T/A304R/ A382S, R259K/A304R, R259K/A304R/M324S, R259K/ A304R/M324S/Q339A, R259K/A304R/M324S/Q339A/ A382S, R259K/A304R/A382S, R262D, R262G, R262H, R262I, R262S, R262T, S263T/A304R, S263T/A304R/ M324S, S263T/A304R/M324S/Q339A, S263T/A304R/ M324S/A382S, S263T/M324S, L270R, L270R/I319A, L270R/C328N/P338S, L270R/C328N/P338S/Q365E, A304R, A304R/M324S, M324S, C328N, D352A, Q365E, H366A, H366L, H366M, H366Q, H366T, H366V, or A382S, wherein the amino acid positions are relative to the reference sequence corresponding to SEQ ID NO: 484.

In some additional embodiments, the amino acid sequence of said engineered leucine decarboxylase polypeptide comprises at least a substitution or substitution set at amino acid position 16/63/80/126/168/366, 16/63/80/126/ 181/194/259/324/328/366, 16/63/126/168/270/328/366, 16/80/126/324/366, 16/80/126/366, 16/80/168, 16/80/168/ 270/366, 16/80/168/324, 16/80/168/366, 16/80/324, 16/91/ 126/168/324/366, 16/126/168/366, 16/168/259/366, 16/168/ 270/324/366, 16/168/324/328/366, 16/168/324/366, 16/168/ 366, 16/259/263/328, 16/324/328/366, 16/328/366, 80/126/ 168/270/366, 80/126/168/366, 80/126/181/270/324/366, 80/168/270/366, or 168/366, wherein the amino acid positions are relative to the reference sequence corresponding to SEQ ID NO: 594. In some additional embodiments, the amino acid sequence of said engineered leucine decarboxylase polypeptide comprises at least a substitution or substitution set 16Q/63C/80K/126T/168K/366M, 16Q/63C/80K/ 126T/181R/194C/259K/324S/328N/366M, 16Q/63C/126T/ 168K/270R/328N/366M, 16Q/80K/126T/324S/366M, 16Q/ 80K/126T/366M, 16Q/80K/168K, 16Q/80K/168K/270R/ 366M, 16Q/80K/168K/324S, 16Q/80K/168K/366M, 16Q/ 80K/324S, 16Q/91A/126T/168K/324S/366M, 16Q/126T/ 168K/366M, 16Q/168K/259K/366M, 16Q/168K/270R/ 324S/366M, 16Q/168K/324S/328N/366M, 16Q/168K/ 324S/366M, 16Q/168K/366M, 16Q/259K/263T/328N, 16Q/324S/328N/366M, 16Q/328N/366M, 80K/126T/168K/ 270R/366M, 80K/126T/168K/366M, 80K/126T/181R/ 270R/324S/366M, 80K/168K/270R/366M, or 168K/366M, wherein the amino acid positions are relative to the reference sequence corresponding to SEQ ID NO: 594. In some additional embodiments, the amino acid sequence of said engineered leucine decarboxylase polypeptide comprises at least a substitution or substitution set R16Q/A63C/A80K/ D126T/C168K/H366M, R16Q/A63C/A80K/D126T/ T181R/F194C/R259K/M324S/C328N/H366M, R16Q/ A63C/D126T/C168K/L270R/C328N/H366M, R16Q/ A80K/D126T/M324S/H366M, R16Q/A80K/D126T/ H366M, R16Q/A80K/C168K, R16Q/A80K/C168K/L270R/ H366M, R16Q/A80K/C168K/M324S, R16Q/A80K/ C168K/H366M, R16Q/A80K/M324S, R16Q/E91A/D126T/ C168K/M324S/H366M, R16Q/D126T/C168K/H366M, R16Q/C168K/R259K/H366M, R16Q/C168K/L270R/ M324S/H366M, R16Q/C168K/M324S/C328N/H366M, R16Q/C168K/M324S/H366M, R16Q/C168K/H366M, R16Q/R259K/S263T/C328N, R16Q/M324S/C328N/ H366M, R16Q/C328N/H366M, A80K/D126T/C168K/ L270R/H366M, A80K/D126T/C168K/H366M, A80K/ D126T/T181R/L270R/M324S/H366M, A80K/C168K/ L270R/H366M, or C168K/H366M, wherein the amino acid positions are relative to the reference sequence corresponding to SEQ ID NO: 594.

In some additional embodiments, the amino acid sequence of said engineered leucine decarboxylase polypeptide comprises at least a substitution or substitution set at amino acid position 66/76/118/141/201/300, 66/76/198/200/ 296/303, 66/76/198/200/300, 66/118/200/296/303/317, 66/118/296, 66/118/296/300, 66/200, 76/118/141/200/296, 76/141/198/200/201/300, 80/201/270, 80/270, 80/270/324, 89/118/200, 106/270/324/352, 118/141/200, 126, 126/201/ 270/324, 126/270, 141/144/198/200/300, 156/270, 156/270/ 324, 201/270, 201/270/352, 270, or 270/324, wherein the amino acid positions are relative to the reference sequence corresponding to SEQ ID NO: 686. In some additional embodiments, the amino acid sequence of said engineered leucine decarboxylase polypeptide comprises at least a substitution or substitution set 66N/76V/118D/141P/201R/ 300K, 66N/76V/198G/200S/296E/303Q, 66N/76V/198G/ 200S/300K, 66N/118D/200S/296E/303Q/317Q, 66N/118D/ 296E, 66N/118D/296E/300K, 66N/200S, 76V/118D/141P/ 200S/296E, 76V/141P/198G/200S/201R/300K, 80K/201D/ 270R, 80K/270R, 80K/270R/324S, 89P/118D/200S, 106M/ 270R/324S/352A, 118D/141P/200S, 126T, 126T/201D/ 270R/324S, 126T/270R, 141P/144V/198G/200S/300K, 156A/270R, 156A/270R/324S, 201D/270R, 201D/270R/ 352A, 270R, or 270R/324S, wherein the amino acid positions are relative to the reference sequence corresponding to SEQ ID NO: 686. In some additional embodiments, the amino acid sequence of said engineered leucine decarboxylase polypeptide comprises at least a substitution or substitution set S66N/R76V/T118D/R141P/E201R/R300K, S66N/R76V/A198G/H200S/D296E/A303Q, S66N/R76V/ A198G/H200S/R300K, S66N/T118D/H200S/D296E/ A303Q/K317Q, S66N/T118D/D296E, S66N/T118D/ D296E/R300K, S66N/H200S, R76V/T118D/R141P/ H200S/D296E, R76V/R141P/A198G/H200S/E201R/ R300K, A80K/E201D/L270R, A80K/L270R, A80K/L270R/ M324S, A89P/T118D/H200S, L106M/L270R/M324S/ D352A, T118D/R141P/H200S, D126T, D126T/E201D/ L270R/M324S, D126T/L270R, R141P/M144V/A198G/ H200S/R300K, G156A/L270R, G156A/L270R/M324S, E201D/L270R, E201D/L270R/D352A, L270R, or L270R/ M324S, wherein the amino acid positions are relative to the reference sequence corresponding to SEQ ID NO: 686.

In some additional embodiments, the amino acid sequence of said engineered leucine decarboxylase polypeptide comprises at least a substitution or substitution set at amino acid position 19, 109, 123, 134, 170, 173, 187, 211, or 312, wherein the amino acid positions are relative to the reference sequence corresponding to SEQ ID NO: 686. In some additional embodiments, the amino acid sequence of said engineered leucine decarboxylase polypeptide comprises at least a substitution or substitution set 19I, 109G, 123F, 123M, 123V, 134A, 134S, 170A, 173A, 173I, 173T, 187L, 211S, or 312A, wherein the amino acid positions are relative to the reference sequence corresponding to SEQ ID NO: 686. In some additional embodiments, the amino acid sequence of said engineered leucine decarboxylase polypeptide comprises at least a substitution or substitution set L19I, L109G, Y123F, Y123M, Y123V, N134A, N134S, P170A, F173A, F173I, F173T, V187L, A211S, and T312A, wherein the amino acid positions are relative to the reference sequence corresponding to SEQ ID NO: 686.

In some additional embodiments, the amino acid sequence of said engineered leucine decarboxylase polypeptide comprises at least a substitution or substitution set at amino acid position 19/109/123/141/170/198/200/211/270/ 312, 19/109/123/141/170/198/211, 19/109/123/141/170/ 198/211/270/312, 19/109/123/170/211/270/312, 19/109/ 123/198/200/211/270/312, 19/109/170/173/211/270/312, 19/109/211/270/312, 109/170/211/270/312, or 109/211/270/ 312, wherein the amino acid positions are relative to the reference sequence corresponding to SEQ ID NO: 688. In some additional embodiments, the amino acid sequence of said engineered leucine decarboxylase polypeptide comprises at least a substitution or substitution set 19I/109G/ 123F/170A/211S/270R/312A, 19I/109G/123F/198G/200S/ 211S/270R/312A, 19I/109G/123V/141P/170A/198G/200S/ 211S/270R/312A, 19I/109G/123V/141P/170A/198G/211S, 19I/109G/123V/141P/170A/198G/211S/270R/312A, 19I/ 109G/170A/173I/211S/270R/312A, 19I/109G/211S/270R/ 312A, 109G/170A/211S/270R/312A, or 109G/211S/270R/ 312A, wherein the amino acid positions are relative to the reference sequence corresponding to SEQ ID NO: 688. In some additional embodiments, the amino acid sequence of said engineered leucine decarboxylase polypeptide comprises at least a substitution or substitution set L19I/L109G/ Y123F/P170A/A211S/L270R/T312A, L19I/L109G/Y123F/ A198G/H200S/A211S/L270R/T312A, L19I/L109G/ Y123V/R141P/P170A/A198G/H200S/A211S/L270R/ T312A, L19I/L109G/Y123V/R141P/P170A/A198G/ A211S, L19I/L109G/Y123V/R141P/P170A/A198G/ A211S/L270R/T312A, L19I/L109G/P170A/F173I/A211S/ L270R/T312A, L19I/L109G/A211S/L270R/T312A, L109G/P170A/A211S/L270R/T312A, or L109G/A211S/ L270R/T312A, wherein the amino acid positions are relative to the reference sequence corresponding to SEQ ID NO: 688.

In some additional embodiments, the amino acid sequence of said engineered leucine decarboxylase polypeptide comprises at least a substitution or substitution set at amino acid position 5/41, 5/41/228, 33, 41, 47, 51, 55, 64, 126, 265, 267, 270, 331, 353, 357, or 384, wherein the amino acid positions are relative to the reference sequence corresponding to SEQ ID NO: 766. In some additional embodiments, the amino acid sequence of said engineered leucine decarboxylase polypeptide comprises at least a substitution or substitution set 5V/41D, 5V/41D/228D, 33L, 41D, 47F, 51E, 51Q, 55I, 64N, 126A, 126T, 265P, 267L, 270A, 270T, 331V, 353E, 353I, 353L, 357S, or 384W, wherein the amino acid positions are relative to the reference sequence corresponding to SEQ ID NO: 766. In some additional embodiments, the amino acid sequence of said engineered leucine decarboxylase polypeptide comprises at least a substitution or substitution set K5V/H41D, K5V/H41D/T228D, F33L, H41D, L47F, L51E, L51Q, V55I, S64N, D126A, D126T, E265P, I267L, R270A, R270T, T331V, D353E, D353I, D353L, C357S, or P384W, wherein the amino acid positions are relative to the reference sequence corresponding to SEQ ID NO: 766.

In some additional embodiments, the amino acid sequence of said engineered leucine decarboxylase polypeptide comprises at least a substitution or substitution set at amino acid position 66, 66/118, 66/118/296, 66/118/296/ 300, 66/118/300, 66/296, 66/296/300, 66/300, 118, 118/296, 118/296/300, 118/300, 296, 296/300, or 300, wherein the amino acid positions are relative to the reference sequence corresponding to SEQ ID NO: 766. In some additional embodiments, the amino acid sequence of said engineered leucine decarboxylase polypeptide comprises at least a substitution or substitution set 66S, 66S/118T, 66S/118T/296D, 66S/118T/296D/300R, 66S/118T/300R, 66S/296D, 66S/ 296D/300R, 66S/300R, 118T, 118T/296D, 118T/296D/ 300R, 118T/300R, 296D, 296D/300R, or 300R, wherein the amino acid positions are relative to the reference sequence corresponding to SEQ ID NO: 766. In some additional embodiments, the amino acid sequence of said engineered leucine decarboxylase polypeptide comprises at least a substitution or substitution set N66S, N66S/D118T, N66S/ D118T/E296D, N66S/D118T/E296D/K300R, N66S/ D118T/K300R, N66S/E296D, N66S/E296D/K300R, N66S/ K300R, D118T, D118T/E296D, D118T/E296D/K300R, D118T/K300R, E296D, E296D/K300R, or K300R, wherein the amino acid positions are relative to the reference sequence corresponding to SEQ ID NO: 766.

In some embodiments, the engineered leucine decarboxylase polypeptides for the therapeutic uses and methods herein are the engineered leucine decarboxylase polypeptides disclosed above and herein.

In some embodiments, the engineered leucine decarboxylase polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence of SEQ ID NO: 828 or 888.

In some embodiments, the engineered leucine decarboxylase polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence corresponding to SEQ ID NO: 828 or 888, wherein the amino acid sequence comprises one or more substitutions relative to a reference sequence corresponding to SEQ ID NO: 828 or 888.

In some embodiments, the engineered leucine decarboxylase polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to the reference sequence corresponding to SEQ ID NO: 828, wherein the amino acid sequence comprises one or more substitutions relative to the reference sequence corresponding to SEQ ID NO: 828.

In some embodiments, the amino acid sequence of the engineered leucine decarboxylase polypeptide comprises at least a substitution at amino acid position 5, 19, 33, 41, 47, 51, 55, 64, 141, 170, 173, 187, 198, 200, 202, 267, 270, 272, 290, 312, 353, 357, 383, or 384, or combinations thereof, wherein the amino acid positions are relative to the reference sequence corresponding to SEQ ID NO: 828.

In some embodiments, the amino acid sequence of the engineered leucine decarboxylase polypeptide comprises at least a substitution at amino acid position 33, 55, 64, 126, 270, or 357, or combinations thereof, wherein the amino acid positions are relative to the reference sequence corresponding to SEQ ID NO: 828.

In some embodiments, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99% or more sequence identity to the reference sequence of SEQ ID NO: 828, and wherein the amino acid sequence comprises at least a substitution or substitution set at amino acid position 170P/383, 270, 41/173, 272, 5/141/272/383, 41/383, 41/141/187/272/290, 41/141/173/290, 5/272/383, 5/41/173/272/383, 41/141, 141/272, 353/384, 272/383, 41/141/173, 41/272/383, 41/141/187/200/202/272, 33/55/64/126/270/357, 33/126/353/357, 55/64/267/35/384, 33/64/357, 126/267, 64/267/353/384, 33/55/64/357, 19/64/126/267, 55/267, 33/126/267/270/312/357, 19/33/55/353/357/384, 19/33/126, 126/312, 126/198/202/267/312, 126/353, 55/126, 126/270/384, 33/64/353/357, 19/267, 51/55/267/270/353, 33/126/267/270, 19/55/64/126/267/270/353, 19/33/126/270/353/357/384, 19/33/64/267/353, 126/353/384, 126/270/312/353/384, 19/33/55/126, 33/357, 47/51/64/126/353/384, 126, or 126/270, wherein the amino acid positions are relative to the reference sequence corresponding to SEQ ID NO: 828. In some additional embodiments, the amino acid sequence of the engineered leucine decarboxylase polypeptide comprises at least a substitution or substitution set 170P/270L/383S, 270L, 41D/173I, 272A, 5V/141P/272A/383S, 41D/383S, 41D/141P/187L/272A/290I, 41D/141P/173I/290I, 5V/272A/383S, 5V/41D/173I/272A/383S, 41D/141P, 141P/272A, 353E/384W, 272A/383S, 41D/141P/173I, 41D/272A/383S, 41D/141P/187L/200S/202H/272A, 33L/55I/64N/126A/270L/357S, 33L/126A/353E/357S, 55I/64N/267L/353E/384W, 33L/64N/357S, 126A/267L, 64N/267L/353E/384W, 33L/55I/64N/357S, 19L/64N/126A/267L, 55I/267L, 33L/126A/267L/270T/312T/357S, 19L/33L/55I/353E/357S/384W, 19L/33L/126A, 126A/312T, 126A/198G/202H/267L/312T, 126A/353E, 55I/126A, 126A/270T/384W, 33L/64N/353E/357S, 19L/267L, 51E/55I/267L/270T/353E, 33L/126A/267L/270T, 19L/55I/64N/126A/267L/270T/353E, 19L/33L/126A/270T/353E/357S/384W, 19L/33L/64N/267L/353E, 126A/353E/384W, 126A/270T/312T/353E/384W, 19L/33L/55I/126A, 33L/357S, 47F/51E/64N/126A/353E/384W, or 126A, 126A/270T, wherein the amino acid positions are relative to the reference sequence corresponding to SEQ ID NO: 828. In some embodiments, amino acid sequence of the engineered leucine decarboxylase polypeptide comprises at least a substitution or substitution set A170P/R270L/A383S, R270L, H41D/F173I, T272A, K5V/R141P/T272A/A383S, H41D/A383S, H41D/R141P/V187L/T272A/V290I, H41D/R141P/F173I/V290I, K5V/T272A/A383S, K5V/H41D/F173I/T272A/A383S, H41D/R141P, R141P/T272A, D353E/P384W, T272A/A383S, H41D/R141P/F173I, H41D/T272A/A383S, H41D/R141P/V187L/H200S/S202H/T272A, F33L/V55I/S64N/D126A/R270L/C357S, F33L/D126A/D353E/C357S, V55I/S64N/I267L/D353E/P384W, F33L/S64N/C357S, D126A/I267L, S64N/I267L/D353E/P384W, F33L/V55I/S64N/C357S, 119L/S64N/D126A/I267L, V55I/I267L, F33L/D126A/I267L/R270T/A312T/C357S, 119L/F33L/V55I/D353E/C357S/P384W, 119L/F33L/D126A, D126A/A312T, D126A/A198G/S202H/I267L/A312T, D126A/D353E, V55I/D126A, D126A/R270T/P384W F33L/S64N/D353E/C357S, I19L/I267L, L51E/V55I/I267L/R270T/D353E, F33L/D126A/I267L/R270T, 119L/V55I/S64N/D126A/I267L/R270T/D353E, 119L/F33L/D126A/R270T/D353E/C357S/P384W, I19L/F33L/S64N/I267L/D353E, D126A/D353E/P384W, D126A/R270T/A312T/D353E/P384W, 119L/F33L/V55I/D126A, F33L/C357S, L47F/L51E/S64N/D126A/D353E/P384W, D126A, or D126A/R270T, wherein the amino acid positions are relative to the reference sequence corresponding to SEQ ID NO: 828.

In some embodiments, the amino acid sequence of the engineered leucine decarboxylase polypeptide comprises at least a substitution at amino acid positions 33, 55, 64, 126, 270, or 357, or combinations thereof, wherein the amino acid positions are relative to the reference sequence corresponding to SEQ ID NO: 828 or 888. In some embodiments, amino acid sequence of the engineered leucine decarboxylase polypeptide comprises at least two or more substitutions of amino acid positions 33, 55, 64, 126, 270, and 357, wherein the amino acid positions are relative to the reference sequence corresponding to SEQ ID NO: 828 or 888. In some embodiments, the amino acid sequence of the engineered leucine decarboxylase polypeptide comprises at least three or more substitutions of amino acid positions 33, 55, 64, 126, 270, and 357, wherein the amino acid positions are relative to the reference sequence corresponding to SEQ ID NO: 828 or 888. In some embodiments, the amino acid sequence of the engineered leucine decarboxylase polypeptide comprises at least substitutions at amino acid positions 33/55, 33/64, 33/126, 33/270, 33/357, 55/64, 55/126, 55/270, 55/357, 64/126, 64/270, 64/357, 126/270, 126/357, or 270/357, wherein the amino acid positions are relative to the reference sequence corresponding to SEQ ID NO: 828 or 888. In some embodiments, the engineered leucine decarboxylase polypeptide comprises at least a substitution set at amino acid position 33/55/64, 33/55/126, 33/64/126, 55/64/270, 55/64/357, or 64/126/270, wherein the amino acid positions are relative to the reference sequence corresponding to SEQ ID NO: 828 or 888. In some embodiments, the amino acid sequence of the engineered leucine decarboxylase polypeptide comprises at least substitutions at amino acid positions 33, 55, 64, 126, 270, and 357, wherein the amino acid positions are relative to the reference sequence corresponding to SEQ ID NO: 828 or 888. In some embodiments, the substitutions at amino acid positions 33, 55, 64, 126, 270, and 357 are selected from 33L, 55I, 64N, 126A, 270L, and 357S. In some embodiments, the substitutions at amino acid positions 33, 55, 64, 126, 270, and 357 are selected from: F33L, V55I, S64N, D126A, R270L, and C357S.

In some embodiments, the engineered leucine decarboxylase comprises an amino acid sequence having at least 80%, 85%, 86%, 87%, 88%, 89%, 90%, 91%, 92%, 93%, 94%, 95%, 96%, 97%, 98%, 99%, or more sequence identity to SEQ ID NO: 888, wherein the amino acid sequence comprises one or more substitutions relative to the reference sequence corresponding to SEQ ID NO: 888.

In some embodiments, the amino acid sequence of the engineered leucine decarboxylase comprises at least a substitution at amino acid position 5, 19, 33, 41, 47, 51, 55, 64, 141, 170, 173, 187, 198, 200, 202, 267, 270, 272, 290, 312, 353, 357, 383, or 384, or combinations thereof, wherein the amino acid positions are relative to the reference sequence corresponding to SEQ ID NO: 888.

In some embodiments, the amino acid sequence of the engineered leucine decarboxylase comprises amino acid residue 5V, 19L, 33L, 41D, 47F, 51E, 55I, 64S/N, 141P, 170P, 173I, 187L, 198G, 200S, 202H, 267L, 270L/T, 272A, 290I, 312T, 353E, 357S/C, 383S, or 384W, or combinations thereof, wherein the amino acid positions are relative to the reference sequence corresponding to SEQ ID NO: 888.

In some embodiments, amino acid sequence of the engineered leucine decarboxylase polypeptide comprises at least a substitution or substitution set 64/173/202/353/384, 41/141/272/353, 141/202/272/353/357, 173/202/357, 202/353, 5/51/173/272/353/384, 51/202/272/357, 141/173/272, 272, 41/173/384, 41/64/141/353/357/383, 141/173/202, 5/51/64/202/353, 357, 64, 5/41/141, 41/141/173/202/353, 353, 202/357, 51/141/202/272/353, 202, 51/141/173/353/384, 41/141/173/202/272/353/383/384, 64/202/357, 5/64/353/383/384, 41/272/353/383, 41/173/272/353/357, 51/141/272/353/357/383/384, 41/353/357, 173/272/353/357, 5/41/64/173/353/357, 64/173/357, 51/272, 51/64/357/384, 51/141/173/272/353, 64/202/272/353/357/384, 51/272/357, 51/173/272/353/384, 353/384, 202/272/357, 64/141/173/202/353/357, 5/41/51/202/357/383, 5/51/173/272/383, 41/141/272, 51/173, 5/353, 41/64/173/272/353/383, 5/64/173/272/353, 51/64, 41/357/383, 41/173/353/357, 202/272/383, 202/272, 353/357, 41/173/202/272/357, 141/173/202/272/353/357, 64/141/202, or 5/173/272, wherein the amino acid positions are relative to the reference sequence corresponding to SEQ ID NO: 888. In some embodiments, the amino acid sequence of the engineered leucine decarboxylase polypeptide comprises at least a substitution or substitution set 64S/173I/202H/353E/384W, 41D/141P/272A/353E, 141P/202H/272A/353E/357C, 173I/202H/357C, 202H/353E, 5V/51E/173I/272A/353E/384W, 51E/202H/272A/357C, 141P/173I/272A, 272A, 41D/173I/384W, 41D/64S/141P/353E/357C/383S, 141P/173I/202H, 5V/51E/64S/202H/353E, 357C, 64S, 5V/41D/141P, 41D/141P/173I/202H/353E, 353E, 202H/357C, 51E/141P/202H/272A/353E, 202H, 51E/141P/173I/353E/384W, 41D/141P/173I/202H/272A/353E/383S/384W, 64S/202H/357C, 5V/64S/353E/383S/384W, 41D/272A/353E/383S, 41D/173I/272A/353E/357C, 51E/141P/272A/353E/357C/383S/384W, 41D/353E/357C, 173I/272A/353E/357C, 5V/41D/64S/173I/353E/357C, 64S/173I/357C, 51E/272A, 51E/64S/357C/384W, 51E/141P/173I/272A/353E, 64S/202H/272A/353E/357C/384W, 51E/272A/357C, 51E/173I/272A/353E/384W, 353E/384W, 202H/272A/357C, 64S/141P/173I/202H/353E/357C, 5V/41D/51E/202H/357C/383S, 5V/51E/173I/272A/383S, 41D/141P/272A, 51E/173I, 5V/353E, 41D/64S/173I/272A/353E/383S, 5V/64S/173I/272A/353E, 51E/64S, 41D/357C/383S, 41D/173I/353E/357C, 202H/272A/383S, 202H/272A, 353E/357C, 41D/173I/202H/272A/357C, 141P/173I/202H/272A/353E/357C, 64S/141P/202H, or 5V/173I/272A, wherein the amino acid positions are relative to the reference sequence corresponding to SEQ ID NO: 888. In some embodiments, amino acid sequence of the engineered leucine decarboxylase polypeptide comprises at least a substitution or substitution set N64S/F173I/S202H/D353E/P384W, H41D/R141P/T272A/D353E, R141P/S202H/T272A/D353E/S357C, F173I/S202H/S357C, S202H/D353E, K5V/L51E/F173I/T272A/D353E/P384W, L51E/S202H/T272A/S357C, R141P/F173I/T272A, T272A, H41D/F173I/P384W, H41D/N64S/R141P/D353E/S357C/A383S, R141P/F173I/S202H, K5V/L51E/N64S/S202H/D353E, S357C, N64S, K5V/H41D/R141P, H41D/R141P/F173I/S202H/D353E, D353E, S202H/S357C, L51E/R141P/S202H/T272A/D353E, S202H, L51E/R141P/F173I/D353E/P384W, H41D/R141P/F173I/S202H/T272A/D353E/A383S/P384W, N64S/S202H/S357C, K5V/N64S/D353E/A383S/P384W, H41D/T272A/D353E/A383S, H41D/F173I/T272A/D353E/S357C, L51E/R141P/T272A/D353E/S357C/A383S/P384W, H41D/D353E/S357C, F173I/T272A/D353E/S357C, K5V/H41D/N64S/F173I/D353E/S357C, N64S/F173I/S357C, L51E/T272A, L51E/N64S/S357C/P384W, L51E/R141P/F173I/T272A/D353E, N64S/S202H/T272A/D353E/S357C/P384W, L51E/T272A/S357C, L51E/F173I/T272A/D353E/P384W, D353E/P384W, S202H/T272A/S357C, N64S/R141P/F173I/S202H/D353E/S357C, K5V/H41D/L51E/S202H/S357C/A383S, K5V/L51E/F173I/T272A/A383S, H41D/R141P/T272A, L51E/F173I, K5V/D353E, H41D/N64S/F173I/T272A/D353E/A383S, K5V/N64S/F173I/T272A/D353E, L51E/N64S, H41D/S357C/A383S, H41D/F173I/D353E/S357C, S202H/T272A/A383S, S202H/T272A, D353E/S357C, H41D/F173I/S202H/T272A/S357C, R141P/F173I/S202H/T272A/D353E/S357C, N64S/R141P/S202H, or K5V/F173I/T272A, wherein the amino acid positions are relative to the reference sequence corresponding to SEQ ID NO: 888.

In some embodiments of the therapeutic uses and methods, the amino acid sequence of the engineered leucine decarboxylase polypeptide comprises a substitution or substitution set of an engineered leucine decarboxylase provided in any of Tables 1-2, 2-1, 3-2, 4-1, 5-1, 6-1, 7-1, 8-1, 8-2, 10-1, 11-1, 11-2, 12-1, and/or 12-2.

In some embodiments of the therapeutic uses and methods, the engineered leucine decarboxylase polypeptide comprises an amino acid sequence of an engineered leucine decarboxylase provided in any of Tables 1-2, 2-1, 3-2, 4-1, 5-1, 6-1, 7-1, 8-1, 8-2, 10-1, 11-1, 11-2, 12-1, and/or 12-2.

In some embodiments of the therapeutic uses and methods, the engineered leucine decarboxylase polypeptide comprises an amino acid sequence having at least 85%, 86%, 87%, 88%, 89%, 90%, 91%, 92%, 93%, 94%, 95%, 96%, 97%, 98%, 99%, or more sequence identity to a sequence corresponding to an even-numbered SEQ ID NO. of SEQ ID NOS: 2-1064. In some embodiments of the therapeutic uses and methods, the engineered leucine decarboxylase polypeptide comprises an amino acid sequence comprising an even-numbered SEQ ID NO. of SEQ ID NOS: 2-1064. In some embodiments of the therapeutic uses and methods uses and methods, the engineered leucine decarboxylase polypeptide comprises an amino acid sequence comprising an even-numbered SEQ ID NO. of SEQ ID NOS: 16-1064.

In some embodiments of the therapeutic uses and methods, the engineered leucine decarboxylase polypeptide comprises an amino acid sequence comprising an even-numbered SEQ ID NO. of SEQ ID NOS: 16-852. In some embodiments of the therapeutic uses and methods, the engineered leucine decarboxylase polypeptide comprises an amino acid sequence comprising an even-numbered SEQ ID NO. of SEQ ID NOS: 16-204. In some embodiments of the therapeutic uses and methods, the engineered leucine decarboxylase polypeptide comprises an amino acid sequence comprising an even-numbered SEQ ID NO. of SEQ ID NOS: 206-278. In some embodiments of the therapeutic uses and methods, the engineered leucine decarboxylase polypeptide comprises an amino acid sequence comprising an even-numbered SEQ ID NO. of SEQ ID NOS: 280-390. In some embodiments of the therapeutic uses and methods, the engineered leucine decarboxylase polypeptide comprises an amino acid sequence comprising an even-numbered SEQ ID NO. of SEQ ID NOS: 392-484. In some embodiments of the therapeutic uses and methods, the engineered leucine decarboxylase polypeptide comprises an amino acid sequence comprising an even-numbered SEQ ID NO. of SEQ ID NOS: 486-636. In some embodiments of the therapeutic uses and methods, the engineered leucine decarboxylase polypeptide comprises an amino acid sequence comprising an even-numbered SEQ ID NO. of SEQ ID NOS: 638-686. In some embodiments of the therapeutic uses and methods, the engineered leucine decarboxylase polypeptide comprises an amino acid sequence comprising an even-numbered SEQ ID NO. of SEQ ID NOS: 688-736. In some embodiments of the therapeutic uses and methods, the engineered leucine decarboxylase polypeptide comprises an amino acid sequence comprising an even-numbered SEQ ID NO. of SEQ ID NOS: 738-762. In some embodiments of the therapeutic uses and methods, the engineered leucine decarboxylase polypeptide comprises an amino acid sequence comprising an even-numbered SEQ ID NO. of SEQ ID NOS: 764-780. In some embodiments of the therapeutic uses and methods, the engineered leucine decarboxylase polypeptide comprises an amino acid sequence comprising an even-numbered SEQ ID NO. of SEQ ID NOS: 782-822. In some embodiments of the therapeutic uses and methods, the engineered leucine decarboxylase polypeptide comprises an amino acid sequence comprising an even-numbered SEQ ID NO. of SEQ ID NOS: 824-852. In some embodiments of the therapeutic uses and methods, the engineered leucine decarboxylase polypeptide comprises an amino acid sequence comprising an even-numbered SEQ ID NO. of SEQ ID NOS: 854-1064.

In some embodiments, the leucine decarboxylase for the therapeutic uses and methods herein exhibits at least one improved property as compared to wild-type Planctomycetaceae bacteria species leucine decarboxylase. In some embodiments, the engineered leucine decarboxylase polypeptide exhibits more activity on leucine than the wild-type Planctomycetaceae species leucine decarboxylase or the leucine decarboxylase having the amino acid sequence corresponding to SEQ ID NO: 12. In some embodiments, the engineered leucine decarboxylase polypeptide is more thermostable than wild-type Planctomycetaceae bacteria species leucine decarboxylase or the leucine decarboxylase having the amino acid sequence corresponding to SEQ ID NO: 12. In some embodiments, the engineered leucine decarboxylase polypeptide more resistant to proteolysis than wild-type Planctomycetaceae bacteria species leucine decarboxylase or the leucine decarboxylase having the amino acid sequence corresponding to SEQ ID NO: 12. In some embodiments, the engineered leucine decarboxylase polypeptide has increased tolerance to low pH environments than wild-type Planctomycetaceae bacteria species leucine decarboxylase or the leucine decarboxylase having the amino acid sequence corresponding to SEQ ID NO: 12. In some embodiments, the engineered leucine decarboxylase polypeptide is less immunogenic than wild-type Planctomycetaceae bacteria species leucine decarboxylase or the leucine decarboxylase having the amino acid sequence corresponding to SEQ ID NO: 12. In some embodiments, the engineered leucine decarboxylase polypeptide is more serum stable than wild-type Planctomycetaceae bacteria species leucine decarboxylase or the leucine decarboxylase having the amino acid sequence corresponding to SEQ ID NO: 12.

In some additional embodiments, a polynucleotide encoding an engineered leucine decarboxylase polypeptide can be used for gene therapy for treating and/or preventing the symptoms of disease or conditions associated with dysfunction in leucine, isoleucine, and/or alloisoleucine metabolism. In some embodiments, the polynucleotide encoding an engineered leucine decarboxylase polypeptide can be used for gene therapy for treating and/or preventing the symptoms of a disease or condition associated with elevated plasma leucine, isoleucine, alloisoleucine and/or ketoisocaproic acid levels. In some embodiments, polynucleotide encoding an engineered leucine decarboxylase polypeptide can be used for gene therapy to treat a subject with maple syrup urine disease, isovaleric acidemia, or 3-methylcrotonyl-CoA carboxylase deficiency. In some embodiments, the polynucleotide encoding an engineered leucine decarboxylase polypeptide is codon-optimized for expression in a human patient. In some embodiments, the polynucleotide for use in gene therapy is DNA or RNA. In some embodiments, the polynucleotide or composition thereof for gene therapy comprises mRNA.

The foregoing and other aspects of the invention may be better understood in connection with the following non-limiting examples. The examples are provided for illustrative purposes only and are not intended to limit the scope of the present invention in any way.

EXPERIMENTAL

The following Examples, including experiments and results achieved, are provided for illustrative purposes only and are not to be construed as limiting the present invention.

In the experimental disclosure below, the following abbreviations apply: ppm (parts per million); M (molar); mM (millimolar), uM and µM (micromolar); nM (nanomolar); mol (moles); gm and g (gram); mg (milligrams); ug and ng (micrograms); L and l (liter); ml and mL (milliliter); cm (centimeters); mm (millimeters); um and µm (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Centigrade); RT and rt (room temperature); CDS (coding sequence); DNA (deoxyribonucleic acid); RNA (ribonucleic acid); AUC (area under the curve); limits of quantitation (LOQ); E. coli W3110 (commonly used laboratory E. coli strain, available from the Coli Genetic Stock Center [CGSC], New Haven, CT); iMSUD (Intermediate Maple Syrup Urine Disease); HTP (high throughput); HPLC (high pressure liquid chromatography); LC (liquid chromatography); MS (mass spectroscopy); LC-MS/MS (liquid chromatography with two mass spectrometers); SPE (solid phase extraction); KIC (ketoisocaproate); IPTG (isopropyl β-D-1-thiogalactopyranoside); PLP (pyridoxal 5'-phosphate); BSA (bovine serum albumin); BW (body weight); MSUD (maple syrup urine disease); FIOPC (fold improvements over positive control); LB (Luria broth); TB (Terrific broth); Innovative Research (Innovative Research, Novi, MI); Microfluidics (Microfluidics Corp., Newton, MA); Thermotron (Thermotron, Holland, MI); Waters (Waters Corp., Milford, MA); Infors (Infors AG, Bottmingen, Switzerland); Cambridge Isotope Laboratories (Cambridge Isotope Laboratories, Inc., Tewksbury, MA); Sigma-Aldrich (Sigma-Aldrich, St. Louis, MO); Applied Biosystems (Applied Biosystems, part of Life Technologies, Corp., Grand Island, NY), Agilent (Agilent Technologies, Inc., Santa Clara, CA); Thermo Scientific (part of Thermo Fisher Scientific, Waltham, MA); Gibco (Gibco part of Thermo Fisher Scientific, Waltham, MA); Khuner (Khuner Shaker, Inc., Santa Clara, CA); BN Labs (British Nutritions, LLC, Irvine, CA); GraphPad Software (GraphPad Software, San Diego, CA); and Corning (Corning, Inc., Palo Alto, CA).

Example 1

High-Throughput (HTP) Growth of *Escherichia coli* (*E. coli*) Expressing Leucine Decarboxylase (LDC) Variants and LDC Screening Conditions HTP Growth of *E. coli* expressing LDC Variants Transformed *E. coli* cells were selected by plating onto LB agar plates containing 1% glucose with selection. After overnight incubation at 37° C., colonies were placed into the wells of 96-well shallow flat bottom plates (Nunc™, Thermo-Scientific) filled with 180 µl/well LB supplemented with 1% glucose and selection. The cultures were allowed to grow overnight for 18-20 hours in a shaker (200 rpm, 30° C., and 85% relative humidity; Kuhner). Overnight growth samples (20 µL) were transferred into Costar® 96-well deep plates (Corning) filled with 380 µL of Terrific Broth supplemented with a selection compound. The plates were incubated for approximately 2 hours in a shaker (250 rpm, 30° C., and 85% relative humidity; Kuhner). The cells were then induced with 40 of 10 mM IPTG and incubated overnight for 20-24 hours in a shaker (250 rpm, 30° C., and 85% relative humidity; Kuhner). The cells were pelleted (4000 rpm×20 mM), the supernatants were discarded, and the cells were frozen at −80° C. prior to lysis.

Lysis of HTP Pellets

*E. coli* cell pellets were lysed with 400 µL of lysis buffer (20 mM sodium phosphate pH 7, 0.04 mM pyridoxal 5'-phosphate (PLP), 1 mg/ml lysozyme, 0.5 g/L polymyxin B sulfate (PMBS)). The mixture was agitated for 1.5 h at room temperature and pelleted (4000 rpm×10 mM) after which the clarified lysates were preincubated for 1 h at 60° C. in a Multitron plate shaker (250 or 400 rpm; Infors HT). The heat-treated lysates were pelleted (4000 rpm×10 min), and the supernatants were used in HTP assays.

HTP Analysis of Clarified Lysates for LDC Activity

LDC activity was assessed by adding diluted heat-treated clarified lysate to a reaction mix for a final concentration of 3 mM leucine in 20 mM sodium phosphate, pH 7.0 or in a mixture of simulated intestinal fluid salts. In some experiments, reaction mix resulting in a final concentration of 3 mM of leucine, isoleucine-d10, valine, methionine, and cysteine (5 AA mix) was used. Reactions were incubated for 1 h at 37° C. at 250 rpm in a Multitron plate shaker (Infors HT) before being quenched with 3 volumes of acetonitrile with 0.1% formic acid, centrifuged for 10 mM at 4° C. at 4000 rpm, and diluted 50-fold in water. The resulting samples were analyzed for isopentylamine, the decarboxylation product of leucine, by RapidFire®-MS/MS (Agilent), and relative activities were determined by dividing the isopentylamine peak area of samples by the isopentylamine peak area of the backbone to compute FIOP (fold improvement over parent) values.

HTP Analysis of Clarified Lysates Pretreated with Simulated Gastric and Intestinal Conditions Heat-treated lysates containing LDC variants were challenged with acidic buffer containing pepsin to simulate the gastric environment. Specifically, heat-treated clarified lysate was preincubated 1:1 with McIlvaine buffer pH 2.8-3 and a final concentration of 0.8 g/L pepsin in Costar® 96-well round bottom plates (Corning). The plates were sealed and incubated for 2 h at 37° C. in a Multitron plate shaker (250 rpm; Infors HT). Subsequently, the simulated gastric challenged lysates were preincubated 1:1 with a final concentration of 4 g/L trypsin and 1.5 g/L chymotrypsin for 2 h at 37° C. in a Multitron plate shaker (250 rpm; Infors HT) to simulate the intestinal environment. After this incubation, the samples were centrifuged, and 40 µL of sample was added to 60 µL of reaction mix for a final concentration of 3 mM leucine in 20 mM sodium phosphate, pH 7 or in a mixture of simulated intestinal fluid salts. In some experiments, reaction mix resulting in a final concentration of 3 mM of leucine, isoleucine-d10, valine, methionine, and cysteine (5 AA mix) was used. Activities of LDC variants were then measured as described above in Example 1.3.

Example 2

Screening Results of LDC Variants

Library variants were generated by recombining beneficial mutations into LDC polypeptide of SEQ ID NO: 828. HTP growth and lysis of *E. coli* cells expressing LDC variants were performed as described in Example 1. Variants were screened for LDC activity in 5 AA mix dissolved in simulated intestinal fluid salt solution after a 2 h simulated gastric (50% McIlvaine buffer pH 3, 0.8 g/L pepsin) and a 2 h intestinal challenge (200 mM sodium phosphate, pH 8, 4 g/L trypsin, 1.5 g/L chymotrypsin). LDC activity was measured as described in Example 1, and analysis of the data relative to SEQ ID NO: 828 is listed in Table 12-1.

TABLE 12.1

LDC Variants Based on SEQ ID NO: 828

| SEQ ID NO: (nt/aa) | Amino Acid Differences (Relative to SEQ ID NO: 828) | Amino Acid Differences (Relative to SEQ ID NO: 12) | "Simulated GI" Challenge, 5 AA Mix FIOP" Relative to SEQ ID NO: 828 |
|---|---|---|---|
| 827/828 | | H14T/R16Q/L19I/T39N/L48F/A64S/V69I/T102S/ L109G/T118D/Y123F/T127S/I164A/C168K/P170A/ A211S/I245M/H255P/R259K/R262T/V267I/L270R/ T275S/D296E/R300K/T312A/R324M/H343E/V349T/ N350E/R353D/I357C/L364R/H366M/A380E/Q388A/ P390* | + |

TABLE 12.1-continued

LDC Variants Based on SEQ ID NO: 828

| SEQ ID NO: (nt/aa) | Amino Acid Differences (Relative to SEQ ID NO: 828) | Amino Acid Differences (Relative to SEQ ID NO: 12) | "Simulated GI" Challenge, 5 AA Mix FIOP" Relative to SEQ ID NO: 828 |
|---|---|---|---|
| 853/854 | A170P/R270L/A383S | H14T/R16Q/L19I/T39N/L48F/A64S/V69I/T102S/ L109G/T118D/Y123F/T127S/I164A/C168K/A211S/ I245M/H255P/R259K/R262T/V267I/T275S/D296E/ R300K/T312A/R324M/H343E/V349T/N350E/R353D/ I357C/L364R/H366M/A380E/A383S/Q388A/P390* | + |
| 855/856 | R270L | H14T/R16Q/L19I/T39N/L48F/A64S/V69I/T102S/ L109G/T118D/Y123F/T127S/I164A/C168K/P170A/ A211S/I245M/H255P/R259K/R262T/V267I/T275S/ D296E/R300K/T312A/R324M/H343E/V349T/N350E/ R353D/I357C/L364R/H366M/A380E/Q388A/P390* | + |
| 857/858 | H41D/F173I | H14T/R16Q/L19I/T39N/H41D/L48F/A64S/V69I/ T102S/L109G/T118D/Y123F/T127S/I164A/C168K/ P170A/F173I/A211S/I245M/H255P/R259K/R262T/ V267I/L270R/T275S/D296E/R300K/T312A/R324M/ H343E/V349T/N350E/R353D/I357C/L364R/H366M/ A380E/Q388A/P390* | ++ |
| 859/860 | T272A | H14T/R16Q/L19I/T39N/L48F/A64S/V69I/T102S/ L109G/T118D/Y123F/T127S/I164A/C168K/P170A/ A211S/I245M/H255P/R259K/R262T/V267I/L270R/ T272A/T275S/D296E/R300K/T312A/R324M/H343E/ V349T/N350E/R353D/I357C/L364R/H366M/A380E/ Q388A/P390* | + |
| 861/862 | K5V/R141P/T272A/ A383S | K5V/H14T/R16Q/L19I/T39N/L48F/A64S/V69I/ T102S/L109G/T118D/Y123F/T127S/R141P/I164A/ C168K/P170A/A211S/I245M/H255P/R259K/R262T/ V267I/L270R/T272A/T275S/D296E/R300K/T312A/ R324M/H343E/V349T/N350E/R353D/I357C/L364R/ H366M/A380E/A383S/Q388A/P390* | + |
| 863/864 | H41D/A383S | H14T/R16Q/L19I/T39N/H41D/L48F/A64S/V69I/ T102S/L109G/T118D/Y123F/T127S/I164A/C168K/ P170A/A211S/I245M/H255P/R259K/R262T/V267I/ L270R/T275S/D296E/R300K/T312A/R324M/H343E/ V349T/N350E/R353D/I357C/L364R/H366M/A380E/ A383S/Q388A/P390* | + |
| 865/866 | H41D/R141P/V187L/ T272A/V290I | H14T/R16Q/L19I/T39N/H41D/L48F/A64S/V69I/ T102S/L109G/T118D/Y123F/T127S/R141P/I164A/ C168K/P170A/V187L/A211S/I245M/H255P/R259K/ R262T/V267I/L270R/T272A/T275S/V290I/D296E/ R300K/T312A/R324M/H343E/V349T/N350E/R353D/ I357C/L364R/H366M/A380E/Q388A/P390* | + |
|

TABLE 12.1-continued

LDC Variants Based on SEQ ID NO: 828

| SEQ ID NO: (nt/aa) | Amino Acid Differences (Relative to SEQ ID NO: 828) | Amino Acid Differences (Relative to SEQ ID NO: 12) | "Simulated GI" Challenge, 5 AA Mix FIOP" Relative to SEQ ID NO: 828 |
|---|---|---|---|
| 877/878 | D353E/P384W | H14T/R16Q/L19I/T39N/L48F/A64S/V69I/T102S/ L109G/T118D/Y123F/T127S/I164A/C168K/P170A/ A211S/I245M/H255P/R259K/R262T/V267I/L270R/ T275S/D296E/R300K/T312A/R324M/H343E/V349T/ N350E/R353E/I357C/L364R/H366M/A380E/P384W/ Q388A/P390* | +++ |
| 879/880 | T272A/A383S | H14T/R16Q/L19I/T39N/L48F/A64S/V69I/T102S/ L109G/T118D/Y123F/T127S/I164A/C168K/P170A/ A211S/I245M/H255P/R259K/R262T/V267I/L270R/ T272A/T275S/D296E/R300K/T312A/R324M/H343E/ V349T/N350E/R353D/I357C/L364R/H366M/A380E/ A383S/Q388A/P390* | + |
| 881/882 | H41D/R141P/F173I | H14T/R16Q/L19I/T39N/H41D/L48F/A64S/V69I/ T102S/L109G/T118D/Y123F/T127S/R141P/I164A/ C168K/P170A/F173I/A211S/I245M/H255P/R259K/ R262T/V267I/L270R/T275S/D296E/R300K/T312A/ R324M/H343E/V349T/N350E/R353D/I357C/L364R/ H366M/A380E/Q388A/P390* | + |
| 883/884 | H41D/T272A/A383S | H14T/R16Q/L19I/T39N/H41D/L48F/A64S/V69I/ T102S/L109G/T118D/Y123F/T127S/I164A/C168K/ P170A/A211S/I245M/H255P/R259K/R262T/V267I/ L270R/T272A/T275S/D296E/R300K/T312A/R324M/ H343E/V349T/N350E/R353D/I357C/L364R/H366M/ A380E/A383S/Q388A/P390* | + |
| 885/886 | H41D/R141P/V187L/ H200S/S202H/T272A | H14T/R16Q/L19I/T39N/H41D/L48F/A64S/V69I/ T102S/L109G/T118D/Y123F/T127S/R141P/I164A/ C168K/P170A/V187L/H200S/S202H/A211S/I245M/ H255P/R259K/R262T/V267I/L270R/T272A/T275S/ D296E/R300K/T312A/R324M/H343E/V349T/N350E/ R353D/I357C/L364R/H366M/A380E/Q388A/P390* | +++ |
| 887/888 | F33L/V55I/S64N/ D126A/R270L/C357S | H14T/R16Q/L19I/F33L/T39N/L48F/V55I/A64N/ V69I/T102S/L109G/T118D/Y123F/D126A/T127S/ I164A/C168K/P170A/A211S/I245M/H255P/R259K/ R262T/V267I/T275S/D296E/R300K/T312A/R324M/ H343E/V349T/N350E/R353D/I357S/L364R/H366M/ A380E/Q388A/P390* | ++ |
| 889/890 | F33L/D126A/D353E/ C357S | H14T/R16Q/L19I/F33L/T39N/L48F/A64S/V69I/ T102S/L109G/T118D/Y123F/D126A/T127S/I164A/ C168K/P170A/A211S/I245M/H255P/R259K/R262T/ V267I/L270R/T275S/D296E/R300K/T312A/R324M/ H343E/V349T/N350E/R353E/I357S/L364R/H366M/ A380E/Q388A/P390* | ++ |
| 891/892 | V55I/S64N/I267L/ D353E/P384W | H14T/R16Q/L19I/T39N/L48F/V55I/A64N/V69I/ T102S/L109G/T118D/Y123F/T127S/I164A/C168K/ P170A/A211S/I245M/H255P/R259K/R262T/V267L/ L270R/T275S/D296E/R300K/T312A/R324M/H343E/ V349T/N350E/R353E/I357C/L364R/H366M/A380E/ P384W/Q388A/P390* | ++ |
| 893/894 | F33L/S64N/C357S | H14T/R16Q/L19I/T39N/F33L/L48F/A64N/V69I/ T102S/L109G/T118D/Y123F/T127S/I164A/C168K/ P170A/A211S/I245M/H255P/R259K/R262T/V267I/ L270R/T275S/D296E/R300K/T312A/R324M/H343E/ V349T/N350E/R353D/I357S/L364R/H366M/A380E/ Q388A/P390* | + |
| 895/896 | D126A/I267L | H14T/R16Q/L19I/T39N/L48F/A64S/V69I/T102S/ L109G/T118D/Y123F/D126A/T127S/I164A/C168K/ P170A/A211S/I245M/H255P/R259K/R262T/V267L/ L270R/T275S/D296E/R300K/T312A/R324M/H343E/ V349T/N350E/R353D/I357C/L364R/H366M/A380E/ Q388A/P390* | +++ |
| 897/898 | S64N/I267L/D353E/ P384W | H14T/R16Q/L19I/T39N/L48F/A64N/V69I/T102S/ L109G/T118D/Y123F/T127S/I164A/C168K/P170A/ A211S/I245M/H255P/R259K/R262T/V267L/L270R/ T275S/D296E/R300K/T312A/R324M/H343E/V349T/ N350E/R353E/I357C/L364R/H366M/A380E/P384W/ Q388A/P390* | ++ |
| 899/900 | F33L/V55I/S64N/ C357S | H14T/R16Q/L19I/F33L/T39N/L48F/V55I/A64N/ V69I/T102S/L109G/T118D/Y123F/T127S/I164A/ C168K/P170A/A211S/I245M/H255P/R259K/R262T/ V267I/L270R/T275S/D296E/R300K/T312A/R324M/ H343E/V349T/N350E/R353D/I357S/L364R/H366M/ A380E/Q388A/P390* | + |

TABLE 12.1-continued

LDC Variants Based on SEQ ID NO: 828

| SEQ ID NO: (nt/aa) | Amino Acid Differences (Relative to SEQ ID NO: 828) | Amino Acid Differences (Relative to SEQ ID NO: 12) | "Simulated GI" Challenge, 5 AA Mix FIOP" Relative to SEQ ID NO: 828 |
|---|---|---|---|
| 901/902 | I19L/S64N/D126A/ I267L | H14T/R16Q/T39N/L48F/A64N/V69I/T102S/L109G/ T118D/Y123F/D126A/T127S/I164A/C168K/P170A/ A211S/I245M/H255P/R259K/R262T/V267L/L270R/ T275S/D296E/R300K/T312A/R324M/H343E/V349T/ N350E/R353D/I357C/L364R/H366M/A380E/Q388A/ P390* | +++ |
| 903/904 | V55I/I267L | H14T/R16Q/L19I/T39N/L48F/V55I/A64S/V69I/ T102S/L109G/T118D/Y123F/T127S/I164A/C168K/ P170A/A211S/I245M/H255P/R259K/R262T/V267L/ L270R/T275S/D296E/R300K/T312A/R324M/H343E/ V349T/N350E/R353D/I357C/L364R/H366M/A380E/ Q388A/P390* | +++ |
| 905/906 | F33L/D126A/I267L/ R270T/A312T/C357S | H14T/R16Q/L19I/F33L/T39N/L48F/A64S/V69I/ T102S/L109G/T118D/Y123F/D126A/T127S/I164A/ C168K/P170A/A211S/I245M/H255P/R259K/R262T/ V267L/L270T/T275S/D296E/R300K/R324M/H343E/ V349T/N350E/R353D/I357S/L364R/H366M/A380E/ Q388A/P390* | +++ |
| 907/908 | I19L/F33L/V55I/ D353E/C357S/P384W | H14T/R16Q/F33L/T39N/L48F/V55I/A64S/V69I/ T102S/L109G/T118D/Y123F/T127S/I164A/C168K/ P170A/A211S/I245M/H255P/R259K/R262T/V267I/ L270R/T275S/D296E/R300K/T312A/R324M/H343E/ V349T/N350E/R353E/I357S/L364R/H366M/A380E/ P384W/Q388A/P390* | + |
| 909/910 | I19L/F33L/D126A | H14T/R16Q/T39N/F33L/L48F/A64S/V69I/T102S/ L109G/T118D/Y123F/D126A/T127S/I164A/C168K/ P170A/A211S/I245M/H255P/R259K/R262T/V267I/ L270R/T275S/D296E/R300K/T312A/R324M/H343E/ V349T/N350E/R353D/I357C/L364R/H366M/A380E/ Q388A/P390* | + |
| 911/912 | D126A/A312T | H14T/R16Q/L19I/T39N/L48F/A64S/V69I/T102S/ L109G/T118D/Y123F/D126A/T127S/I164A/C168K/ P170A/A211S/I245M/H255P/R259K/R262T/V267I/ L270R/T275S/D296E/R300K/R324M/H343E/V349T/ N350E/R353D/I357C/L364R/H366M/A380E/Q388A/ P390* | + |
| 913/914 | D126A/A198G/S202H/ I267L/A312T | H14T/R16Q/L19I/T39N/L48F/A64S/V69I/T102S/ L109G/T118D/Y123F/D126A/T127S/I164A/C168K/ P170A/A198G/S202H/A211S/I245M/H255P/R259K/ R262T/V267L/L270R/T275S/D296E/R300K/R324M/ H343E/V349T/N350E/R353D/I357C/L364R/H366M/ A380E/Q388A/P390* | +++ |
| 915/916 | D126A/D353E | H14T/R16Q/L19I/T39N/L48F/A64S/V69I/T102S/ L109G/T118D/Y123F/D126A/T127S/I164A/C168K/ P170A/A211S/I245M/H255P/R259K/R262T/V267I/ L270R/T275S/D296E/R300K/T312A/R324M/H343E/ V349T/N350E/R353E/I357C/L364R/H366M/A380E/ Q388A/P390* | + |
| 917/918 | V55I/D126A | H14T/R16Q/L19I/T39N/L48F/V55I/A64S/V69I/ T102S/L109G/T118D/Y123F/D126A/T127S/I164A/ C168K/P170A/A211S/I245M/H255P/R259K/R262T/ V267I/L270R/T275S/D296E/R300K/T312A/R324M/ H343E/V349T/N350E/R353D/I357C/L364R/H366M/ A380E/Q388A/P390* | + |
| 919/920 | D126A/R270T/P384W | H14T/R16Q/L19I/T39N/L48F/A64S/V69I/T102S/ L109G/T118D/Y123F/D126A/T127S/I164A/C168K/ P170A/A211S/I245M/H255P/R259K/R262T/V267I/ L270T/T275S/D296E/R300K/T312A/R324M/H343E/ V349T/N350E/R353D/I357C/L364R/H366M/A380E/ P384W/Q388A/P390* | ++ |
| 921/922 | F33L/S64N/D353E/ C357S | H14T/R16Q/L19I/F33L/T39N/L48F/A64N/V69I/ T102S/L109G/T118D/Y123F/T127S/I164A/C168K/ P170A/A211S/I245M/H255P/R259K/R262T/V267I/ L270R/T275S/D296E/R300K/T312A/R324M/H343E/ V349T/N350E/R353E/I357S/L364R/H366M/A380E/ Q388A/P390* | ++ |

TABLE 12.1-continued

LDC Variants Based on SEQ ID NO: 828

| SEQ ID NO: (nt/aa) | Amino Acid Differences (Relative to SEQ ID NO: 828) | Amino Acid Differences (Relative to SEQ ID NO: 12) | "Simulated GI" Challenge, 5 AA Mix FIOP" Relative to SEQ ID NO: 828 |
|---|---|---|---|
| 923/924 | I19L/I267L | H14T/R16Q/T39N/L48F/A64S/V69I/T102S/L109G/ T118D/Y123F/T127S/I164A/C168K/P170A/A211S/ I245M/H255P/R259K/R262T/V267L/L270R/T275S/ D296E/R300K/T312A/R324M/H343E/V349T/N350E/ R353D/I357C/L364R/H366M/A380E/Q388A/P390* | ++ |
| 925/926 | L51E/V55I/I267L/ R270T/D353E | H14T/R16Q/L19I/T39N/L48F/L51E/V55I/A64S/ V69I/T102S/L109G/T118D/Y123F/T127S/I164A/ C168K/P170A/A211S/I245M/H255P/R259K/R262T/ V267L/L270T/T275S/D296E/R300K/T312A/R324M/ H343E/V349T/N350E/R353E/I357C/L364R/H366M/ A380E/Q388A/P390* | +++ |
| 927/928 | F33L/D126A/I267L/ R270T | H14T/R16Q/L19I/F33L/T39N/L48F/A64S/V69I/ T102S/L109G/T118D/Y123F/D126A/T127S/I164A/ C168K/P170A/A211S/I245M/H255P/R259K/R262T/ V267L/L270T/T275S/D296E/R300K/T312A/R324M/ H343E/V349T/N350E/R353D/I357C/L364R/H366M/ A380E/Q388A/P390* | ++ |
| 929/930 | I19L/V55I/S64N/ D126A/I267L/R270T/ D353E | H14T/R16Q/T39N/L48F/V55I/A64N/V69I/T102S/ L109G/T118D/Y123F/D126A/T127S/I164A/C168K/ P170A/A211S/I245M/H255P/R259K/R262T/V267L/ L270T/T275S/D296E/R300K/T312A/R324M/H343E/ V349T/N350E/R353E/I357C/L364R/H366M/A380E/ Q388A/P390* | ++ |
| 931/932 | I19L/F33L/D126A/ R270T/D353E/C357S/ P384W | H14T/R16Q/F33L/T39N/L48F/A64S/V69I/T102S/ L109G/T118D/Y123F/D126A/T127S/I164A/C168K/ P170A/A211S/I245M/H255P/R259K/R262T/V267I/ L270T/T275S/D296E/R300K/T312A/R324M/H343E/ V349T/N350E/R353E/I357S/L364R/H366M/A380E/ P384W/Q388A/P390* | + |
| 933/934 | I19L/F33L/S64N/ I267L/D353E | H14T/R16Q/F33L/T39N/L48F/A64N/V69I/T102S/ L109G/T118D/Y123F/T127S/I164A/C168K/P170A/ A211S/I245M/H255P/R259K/R262T/V267L/L270R/ T275S/D296E/R300K/T312A/R324M/H343E/V349T/ N350E/R353E/I357C/L364R/H366M/A380E/Q388A/ P390* | ++ |
| 935/936 | D126A/D353E/P384W | H14T/R16Q/L19I/T39N/L48F/A64S/V69I/T102S/ L109G/T118D/Y123F/D126A/T127S/I164A/C168K/ P170A/A211S/I245M/H255P/R259K/R262T/V267I/ L270R/T275S/D296E/R300K/T312A/R324M/H343E/ V349T/N350E/R353E/I357C/L364R/H366M/A380E/ P384W/Q388A/P390* | + |
| 937/938 | D126A/R270T/A312T/ D353E/P384W | H14T/R16Q/L19I/T39N/L48F/A64S/V69I/T102S/ L109G/T118D/Y123F/D126A/T127S/I164A/C168K/ P170A/A211S/I245M/H255P/R259K/R262T/V267I/ L270T/T275S/D296E/R300K/R324M/H343E/V349T/ N350E/R353E/I357C/L364R/H366M/A380E/P384W/ Q388A/P390* | + |
| 939/940 | I19L/F33L/V55I/ D126A | H14T/R16Q/F33L/T39N/L48F/V55I/A64S/V69I/ T102S/L109G/T118D/Y123F/D126A/T127S/I164A/ C168K/P170A/A211S/I245M/H255P/R259K/R262T/ V267I/L270R/T275S/D296E/R300K/T312A/R324M/ H343E/V349T/N350E/R353D/I357C/L364R/H366M/ A380E/Q388A/P390* | + |
| 941/942 | F33L/C357S | H14T/R16Q/L19I/F33L/T39N/L48F/A64S/V69I/ T102S/L109G/T118D/Y123F/T127S/I164A/C168K/ P170A/A211S/I245M/H255P/R259K/R262T/V267I/ L270R/T275S/D296E/R300K/T312A/R324M/H343E/ V349T/N350E/R353D/I357S/L364R/H366M/A380E/ Q388A/P390* | ++ |
| 943/944 | L47F/L51E/S64N/ D126A/D353E/P384W | H14T/R16Q/L19I/T39N/L47F/L48F/L51E/A64N/ V69I/T102S/L109G/T118D/Y123F/D126A/T127S/ I164A/C168K/P170A/A211S/I245M/H255P/R259K/ R262T/V267I/L270R/T275S/D296E/R300K/T312A/ R324M/H343E/V349T/N350E/R353E/I357C/L364R/ H366M/A380E/P384W/Q388A/P390* | ++ |
| 945/946 | D126A | H14T/R16Q/L19I/T39N/L48F/A64S/V69I/T102S/ L109G/T118D/Y123F/D126A/T127S/I164A/C168K/ P170A/A211S/I245M/H255P/R259K/R262T/V267I/ L270R/T275S/D296E/R300K/T312A/R324M/H343E/ V349T/N350E/R353D/I357C/L364R/H366M/A380E/ Q388A/P390* | + |

TABLE 12.1-continued

LDC Variants Based on SEQ ID NO: 828

| SEQ ID NO: (nt/aa) | Amino Acid Differences (Relative to SEQ ID NO: 828) | Amino Acid Differences (Relative to SEQ ID NO: 12) | "Simulated GI" Challenge, 5 AA Mix FIOP" Relative to SEQ ID NO: 828 |
|---|---|---|---|
| 947/948 | D126A/R270T | H14T/R16Q/L19I/T39N/L48F/A64S/V69I/T102S/ L109G/T118D/Y123F/D126A/T127S/I164A/C168K/ P170A/A211S/I245M/H255P/R259K/R262T/V267I/ L270T/T275S/D296E/R300K/T312A/R324M/H343E/ V349T/N350E/R353D/I357C/L364R/H366M/A380E/ Q388A/P390* | + |

Levels of increased activity were determined relative to the reference polypeptide of SEQ ID NO: 828 and defined as follows: "+" 1.00 to 1.21 (first 50%), "++" > 1.21 (next 30%), "+++" > 1.54 (top 20%)

Based on the results from Table 12-2, SEQ ID NO: 888 was chosen as the backbone. Beneficial mutations identified from Table 12-1 were recombined into the backbone. The resulting variants were screened for unchallenged activity on leucine by incubating 20 µL of 80× diluted heat-treated clarified lysate with 80 µL of reaction mix for a final concentration of 3 mM leucine and 0.01 mM PLP in 20 mM sodium phosphate, pH 7. Variants were also screened for LDC activity in 5 AA mix with 0.01 mM PLP dissolved in 20 mM sodium phosphate, pH 7 after a 2 h simulated gastric (50% McIlvaine buffer pH 2.8, 0.8 g/L pepsin) and a 2 h intestinal challenge (200 mM sodium phosphate, pH 8, 4 g/L trypsin, 1.5 g/L chymotrypsin). LDC activity was measured as described in Example 1, and analysis of the data relative to SEQ ID NO: 888 is listed in Table 12-2.

TABLE 12.2

LDC Variants Based on SEQ ID NO: 888

| SEQ ID NO: (nt/aa) | Amino Acid Differences (Relative to SEQ ID NO: 888) | Amino Acid Differences (Relative to SEQ ID NO: 12) | Unchallenged Leu FIOP Relative to SEQ ID NO: 888[1] | Simulated GI Challenge, 5 AA Mix FIOP Relative to SEQ ID NO: 888[2] |
|---|---|---|---|---|
| 949/950 | N64S/F173I/S202H/ D353E/P384W | H14T/R16Q/L19I/F33L/T39N/L48F/ V55I/A64S/V69I/T102S/L109G/T118D/ Y123F/D126A/T127S/I164A/C168K/ P170A/F173I/S202H/A211S/I245M/ H255P/R259K/R262T/V267I/T275S/ D296E/R300K/T312A/R324M/H343E/ V349T/N350E/R353E/I357S/L364R/ H366M/A380E/P384W/Q388A/P390* | ++ | + |
| 951/952 | H41D/R141P/T272A/ D353E | H14T/R16Q/L19I/F33L/T39N/H41D/ L48F/V55I/A64N/V69I/T102S/L109G/ T118D/Y123F/D126A/T127S/R141P/ I164A/C168K/P170A/A211S/I245M/ H255P/R259K/R262T/V267I/T272A/ T275S/D296E/R300K/T312A/R324M/ H343E/V349T/N350E/R353E/I357S/ L364R/H366M/A380E/Q388A/P390* | + | ++ |
| 953/954 | R141P/S202H/T272A/ D353E/S357C | H14T/R16Q/L19I/F33L/T39N/L48F/ V55I/A64N/V69I/T102S/L109G/T118D/ Y123F/D126A/T127S/R141P/I164A/ C168K/P170A/S202H/A211S/I245M/ H255P/R259K/R262T/V267I/T272A/ T275S/D296E/R300K/T312A/R324M/ H343E/V349T/N350E/R353E/I357C/ L364R/H366M/A380E/Q388A/P390* | ++ | + |
| 955/956 | F173I/S202H/S357C | H14T/R16Q/L19I/F33L/T39N/L48F/ V55I/A64N/V69I/T102S/L109G/T118D/ Y123F/D126A/T127S/I164A/C168K/ P170A/F173I/S202H/S202H/A211S/ I245M/H255P/R259K/R262T/V267I/ T275S/D296E/R300K/T312A/R324M/ H343E/V349T/N350E/R353D/I357C/ L364R/H366M/A380E/Q388A/P390* | +++ | + |
| 957/958 | S202H/D353E | H14T/R16Q/L19I/F33L/T39N/L48F/ V55I/A64N/V69I/T102S/L109G/T118D/ Y123F/D126A/T127S/I164A/C168K/ P170A/S202H/A211S/I245M/H255P/ R259K/R262T/V267I/T275S/D296E/ R300K/T312A/R324M/H343E/V349T/ N350E/R353E/I357S/L364R/H366M/ A380E/Q388A/P390* | ++ | + |

TABLE 12.2-continued

LDC Variants Based on SEQ ID NO: 888

| SEQ ID NO: (nt/aa) | Amino Acid Differences (Relative to SEQ ID NO: 888) | Amino Acid Differences (Relative to SEQ ID NO: 12) | Unchallenged Leu FIOP Relative to SEQ ID NO: 888[1] | Simulated GI Challenge, 5 AA Mix FIOP Relative to SEQ ID NO: 888[2] |
|---|---|---|---|---|
| 959/960 | K5V/L51E/F173I/ T272A/D353E/P384W | K5V/H14T/R16Q/L19I/F33L/T39N/ L48F/L51E/V55I/A64N/V69I/T102S/ L109G/T118D/Y123F/D126A/T127S/ I164A/C168K/P170A/F173I/A211S/ I245M/H255P/R259K/R262T/V267I/ T272A/T275S/D296E/R300K/T312A/ R324M/H343E/V349T/N350E/R353E/ I357S/L364R/H366M/A380E/P384W/ Q388A/P390* | + | +++ |
| 961/962 | L51E/S202H/T272A/ S357C | H14T/R16Q/L19I/F33L/T39N/L48F/ L51E/V55I/A64N/V69I/T102S/L109G/ T118D/Y123F/D126A/T127S/I164A/ C168K/P170A/S202H/A211S/I245M/ H255P/R259K/R262T/V267I/T272A/ T275S/D296E/R300K/T312A/R324M/ H343E/V349T/N350E/R353D/I357C/ L364R/H366M/A380E/Q388A/P390* | ++ | + |
| 963/964 | R141P/F173I/T272A | H14T/R16Q/L19I/F33L/T39N/L48F/ V55I/A64N/V69I/T102S/L109G/T118D/ Y123F/D126A/T127S/R141P/I164A/ C168K/P170A/F173I/A211S/I245M/ H255P/R259K/R262T/V267I/T272A/ T275S/D296E/R300K/T312A/R324M/ H343E/V349T/N350E/R353D/I357S/ L364R/H366M/A380E/Q388A/P390* | + | ++ |
| 965/966 | T272A | H14T/R16Q/L19I/F33L/T39N/L48F/ V55I/A64N/V69I/T102S/L109G/T118D/ Y123F/D126A/T127S/I164A/C168K/ P170A/A211S/I245M/H255P/R259K/ R262T/V267I/T272A/T275S/D296E/ R300K/T312A/R324M/H343E/V349T/ N350E/R353D/I357S/L364R/H366M/ A380E/Q388A/P390* | + | ++ |
| 967/968 | H41D/F173I/P384W | H14T/R16Q/L19I/F33L/T39N/H41D/ L48F/V55I/A64N/V69I/T102S/L109G/ T118D/Y123F/D126A/T127S/I164A/ C168K/P170A/F173I/A211S/I245M/ H255P/R259K/R262T/V267I/T275S/ D296E/R300K/T312A/R324M/H343E/ V349T/N350E/R353D/I357S/L364R/ H366M/A380E/P384W/Q388A/P390* | ++ | + |
| 969/970 | H41D/N64S/R141P/ D353E/S357C/A383S | H14T/R16Q/L19I/F33L/T39N/H41D/ L48F/V55I/A64S/V69I/T102S/L109G/ T118D/Y123F/D126A/T127S/R141P/ I164A/C168K/P170A/A211S/I245M/ H255P/R259K/R262T/V267I/T275S/ D296E/R300K/T312A/R324M/H343E/ V349T/N350E/R353E/I357C/L364R/ H366M/A380E/A383S/Q388A/P390* | +++ | + |
| 971/972 | R141P/F173I/S202H | H14T/R16Q/L19I/F33L/T39N/L48F/ V55I/A64N/V69I/T102S/L109G/T118D/ Y123F/D126A/T127S/R141P/I164A/ C168K/P170A/F173I/S202H/A211S/ I245M/H255P/R259K/R262T/V267I/ T275S/D296E/R300K/T312A/R324M/ H343E/V349T/N350E/R353D/I357S/ L364R/H366M/A380E/Q388A/P390* | ++ | ++ |
| 973/974 | K5V/L51E/N64S/ S202H/D353E | K5V/H14T/R16Q/L19I/F33L/T39N/ L48F/L51E/V55I/A64S/V69I/T102S/ L109G/T118D/Y123F/D126A/T127S/ I164A/C168K/P170A/S202H/A211S/ I245M/H255P/R259K/R262T/V267I/ T275S/D296E/R300K/T312A/R324M/ H343E/V349T/N350E/R353E/I357S/ L364R/H366M/A380E/Q388A/P390* | + | ++ |

TABLE 12.2-continued

LDC Variants Based on SEQ ID NO: 888

| SEQ ID NO: (nt/aa) | Amino Acid Differences (Relative to SEQ ID NO: 888) | Amino Acid Differences (Relative to SEQ ID NO: 12) | Unchallenged Leu FIOP Relative to SEQ ID NO: 888[1] | Simulated GI Challenge, 5 AA Mix FIOP Relative to SEQ ID NO: 888[2] |
|---|---|---|---|---|
| 975/976 | S357C | H14T/R16Q/L19I/F33L/T39N/L48F/ V55I/A64N/V69I/T102S/L109G/T118D/ Y123F/D126A/T127S/I164A/C168K/ P170A/A211S/I245M/H255P/R259K/ R262T/V267I/T275S/D296E/R300K/ T312A/R324M/H343E/V349T/N350E/ R353D/I357C/L364R/H366M/A380E/ Q388A/P390* | ++ | + |
| 977/978 | IN64S | H14T/R16Q/L19I/F33L/T39N/L48F/ V55I/A64S/V69I/T102S/L109G/T118D/ Y123F/D126A/T127S/I164A/C168K/ P170A/A211S/I245M/H255P/R259K/ R262T/V267I/T275S/D296E/R300K/ T312A/R324M/H343E/V349T/N350E/ R353D/I357S/L364R/H366M/A380E/ Q388A/P390* | + | ++ |
| 979/980 | K5V/H41D/R141P | K5V/H14T/R16Q/L19I/F33L/T39N/ H41D/L48F/V55I/A64N/V69I/T102S/ L109G/T118D/Y123F/D126A/T127S/ R141P/I164A/C168K/P170A/A211S/ I245M/H255P/R259K/R262T/V267I/ T275S/D296E/R300K/T312A/R324M/ H343E/V349T/N350E/R353D/I357S/ L364R/H366M/A380E/Q388A/P390* | + | + |
| 981/982 | H41D/R141P/F173I/ S202H/D353E | H14T/R16Q/L19I/F33L/T39N/H41D/ L48F/V55I/A64N/V69I/T102S/L109G/ T118D/Y123F/D126A/T127S/R141P/ I164A/C168K/P170A/F173I/S202H/ A211S/I245M/H255P/R259K/R262T/ V267I/T275S/D296E/R300K/T312A/ R324M/H343E/V349T/N350E/R353E/ I357S/L364R/H366M/A380E/Q388A/ P390* | + | ++ |
| 983/984 | D353E | H14T/R16Q/L19I/F33L/T39N/L48F/ V55I/A64N/V69I/T102S/L109G/T118D/ Y123F/D126A/T127S/I164A/C168K/ P170A/A211S/I245M/H255P/R259K/ R262T/V267I/T275S/D296E/R300K/ T312A/R324M/H343E/V349T/N350E/ R353E/I357S/L364R/H366M/A380E/ Q388A/P390* | ++ | + |
| 985/986 | S202H/S357C | H14T/R16Q/L19I/F33L/T39N/L48F/ V55I/A64N/V69I/T102S/L109G/T118D/ Y123F/D126A/T127S/I164A/C168K/ P170A/S202H/A211S/I245M/H255P/ R259K/R262T/V267I/T275S/D296E/ R300K/T312A/R324M/H343E/V349T/ N350E/R353D/I357C/L364R/H366M/ A380E/Q388A/P390* | +++ | + |
| 987/988 | L51E/R141P/S202H/ T272A/D353E | H14T/R16Q/L19I/F33L/T39N/L48F/ V55I/A64N/V69I/T102S/L109G/T118D/ Y123F/D126A/T127S/R141P/I164A/ C168K/P170A/S202H/S202H/A211S/ I245M/H255P/R259K/R262T/V267I/ T272A/T275S/D296E/R300K/T312A/ R324M/H343E/V349T/N350E/R353E/ I357S/L364R/H366M/A380E/Q388A/ P390* | + | +++ |
| 989/990 | S202H | H14T/R16Q/L19I/F33L/T39N/L48F/ V55I/A64N/V69I/T102S/L109G/T118D/ Y123F/D126A/T127S/I164A/C168K/ P170A/S202H/A211S/I245M/H255P/ R259K/R262T/V267I/T275S/D296E/ R300K/T312A/R324M/H343E/V349T/ N350E/R353D/I357S/L364R/H366M/ A380E/Q388A/P390* | + | + |
| 991/992 | L51E/R141P/F173I/ D353E/P384W | H14T/R16Q/L19I/F33L/T39N/L48F/ L51E/V55I/A64N/V69I/T102S/L109G/ T118D/Y123F/D126A/T127S/R141P/ I164A/C168K/P170A/F173I/A211S/ I245M/H255P/R259K/R262T/V267I/ T275S/D296E/R300K/T312A/R324M/ | + | +++ |

TABLE 12.2-continued

LDC Variants Based on SEQ ID NO: 888

| SEQ ID NO: (nt/aa) | Amino Acid Differences (Relative to SEQ ID NO: 888) | Amino Acid Differences (Relative to SEQ ID NO: 12) | Unchallenged Leu FIOP Relative to SEQ ID NO: 888[1] | Simulated GI Challenge, 5 AA Mix FIOP Relative to SEQ ID NO: 888[2] |
|---|---|---|---|---|
|  |  | H343E/V349T/N350E/R353E/I357S/ L364R/H366M/A380E/P384W/Q388A/ P390* |  |  |
| 993/994 | H41D/R141P/F173I/ S202H/T272A/D353E/ A383S/P384W | H14T/R16Q/L19I/F33L/T39N/H41D/ L48F/V55I/A64N/V69I/T102S/L109G/ T118D/Y123F/D126A/T127S/R141P/ I164A/C168K/P170A/F173I/S202H/ A211S/I245M/H255P/R259K/R262T/ V267I/T272A/T275S/D296E/R300K/ T312A/R324M/H343E/V349T/N350E/ R353E/I357S/L364R/H366M/A380E/ A383S/P384W/Q388A/P390* | + | +++ |
| 995/996 | N64S/S202H/S357C | H14T/R16Q/L19I/F33L/T39N/L48F/ V55I/A64S/V69I/T102S/L109G/T118D/ Y123F/D126A/T127S/I164A/C168K/ P170A/S202H/A211S/I245M/H255P/ R259K/R262T/V267I/T275S/D296E/ R300K/T312A/R324M/H343E/V349T/ N350E/R353D/I357C/L364R/H366M/ A380E/Q388A/P390* | ++ | + |
| 997/998 | K5V/N64S/D353E/ A383S/P384W | K5V/H14T/R16Q/L19I/F33L/T39N/ L48F/V55I/A64S/V69I/T102S/L109G/ T118D/Y123F/D126A/T127S/I164A/ C168K/P170A/A211S/I245M/H255P/ R259K/R262T/V267I/T275S/D296E/ R300K/T312A/R324M/H343E/V349T/ N350E/R353E/I357S/L364R/H366M/ A380E/A383S/P384W/Q388A/P390* | + | ++ |
| 999/1000 | H41D/T272A/D353E/ A383S | H14T/R16Q/L19I/F33L/T39N/H41D/ L48F/V55I/A64N/V69I/T102S/L109G/ T118D/Y123F/D126A/T127S/I164A/ C168K/P170A/A211S/I245M/H255P/ R259K/R262T/V267I/T272A/T275S/ D296E/R300K/T312A/R324M/H343E/ V349T/N350E/R353E/I357S/L364R/ H366M/A380E/A383S/Q388A/P390* | + | ++ |
| 1001/1002 | H41D/F173I/T272A/ D353E/S357C | H14T/R16Q/L19I/F33L/T39N/H41D/ L48F/V55I/A64N/V69I/T102S/L109G/ T118D/Y123F/D126A/T127S/I164A/ C168K/P170A/F173I/A211S/I245M/ H255P/R259K/R262T/V267I/T272A/ T275S/D296E/R300K/T312A/R324M/ H343E/V349T/N350E/R353E/I357C/ L364R/H366M/A380E/Q388A/P390* | ++ | + |
| 1003/1004 | L51E/R141P/T272A/ D353E/S357C/A383S/ P384W | H14T/R16Q/L19I/F33L/T39N/L48F/ L51E/V55I/A64N/V69I/T102S/L109G/ T118D/Y123F/D126A/T127S/R141P/ I164A/C168K/P170A/A211S/I245M/ H255P/R259K/R262T/V267I/T272A/ T275S/D296E/R300K/T312A/R324M/ H343E/V349T/N350E/R353E/I357C/ L364R/H366M/A380E/A383S/P384W/ Q388A/P390* | ++ | + |
| 1005/1006 | H41D/D353E/S357C | H14T/R16Q/L19I/F33L/T39N/H41D/ L48F/V55I/A64N/V69I/T102S/L109G/ T118D/Y123F/D126A/T127S/I164A/ C168K/P170A/A211S/I245M/H255P/ R259K/R262T/V267I/T275S/D296E/ R300K/T312A/R324M/H343E/V349T/ N350E/R353E/I357C/L364R/H366M/ A380E/Q388A/P390* | +++ | + |
| 1007/1008 | F173I/T272A/D353E/ S357C | H14T/R16Q/L19I/F33L/T39N/L48F/ V55I/A64N/V69I/T102S/L109G/T118D/ Y123F/D126A/T127S/I164A/C168K/ P170A/F173I/A211S/I245M/H255P/ R259K/R262T/V267I/T272A/T275S/ D296E/R300K/T312A/R324M/H343E/ V349T/N350E/R353E/I357C/L364R/ H366M/A380E/Q388A/P390* | ++ | + |
| 1009/1010 | K5V/H41D/N64S/ F173I/D353E/S357C | K5V/H14T/R16Q/L19I/F33L/T39N/ H41D/L48F/V55I/A64S/V69I/T102S/ L109G/T118D/Y123F/D126A/T127S/ | ++ | + |

TABLE 12.2-continued

LDC Variants Based on SEQ ID NO: 888

| SEQ ID NO: (nt/aa) | Amino Acid Differences (Relative to SEQ ID NO: 888) | Amino Acid Differences (Relative to SEQ ID NO: 12) | Unchallenged Leu FIOP Relative to SEQ ID NO: 888[1] | Simulated GI Challenge, 5 AA Mix FIOP Relative to SEQ ID NO: 888[2] |
|---|---|---|---|---|
| | | I164A/C168K/P170A/F173I/A211S/ I245M/H255P/R259K/R262T/V267I/ T275S/D296E/R300K/T312A/R324M/ H343E/V349T/N350E/R353E/I357C/ L364R/H366M/A380E/Q388A/P390* | | |
| 1011/1012 | N64S/F173I/S357C | H14T/R16Q/L19I/F33L/T39N/L48F/ V55I/A64S/V69I/T102S/L109G/T118D/ Y123F/D126A/T127S/I164A/C168K/ P170A/F173I/A211S/I245M/H255P/ R259K/R262T/V267I/T275S/D296E/ R300K/T312A/R324M/H343E/V349T/ N350E/R353D/I357C/L364R/H366M/ A380E/Q388A/P390* | ++ | + |
| 1013/1014 | L51E/T272A | H14T/R16Q/L19I/F33L/T39N/L48F/ L51E/V55I/A64N/V69I/T102S/L109G/ T118D/Y123F/D126A/T127S/I164A/ C168K/P170A/A211S/I245M/H255P/ R259K/R262T/V267I/T272A/T275S/ D296E/R300K/T312A/R324M/H343E/ V349T/N350E/R353D/I357S/L364R/ H366M/A380E/Q388A/P390* | + | ++ |
| 1015/1016 | L51E/N64S/S357C/ P384W | H14T/R16Q/L19I/F33L/T39N/L48F/ L51E/V55I/A64S/V69I/T102S/L109G/ T118D/Y123F/D126A/T127S/I164A/ C168K/P170A/A211S/I245M/H255P/ R259K/R262T/V267I/T275S/D296E/ R300K/T312A/R324M/H343E/V349T/ N350E/R353D/I357C/L364R/H366M/ A380E/P384W/Q388A/P390* | +++ | + |
| 1017/1018 | L51E/R141P/F173I/ T272A/D353E | H14T/R16Q/L19I/F33L/T39N/L48F/ L51E/V55I/A64N/V69I/T102S/L109G/ T118D/Y123F/D126A/T127S/R141P/ I164A/C168K/P170A/F173I/A211S/ I245M/H255P/R259K/R262T/V267I/ T272A/T275S/D296E/R300K/T312A/ R324M/H343E/V349T/N350E/R353E/ I357S/L364R/H366M/A380E/Q388A/ P390* | + | +++ |
| 1019/1020 | N64S/S202H/T272A/ D353E/S357C/P384W | H14T/R16Q/L19I/F33L/T39N/L48F/ V55I/A64S/V69I/T102S/L109G/T118D/ Y123F/D126A/T127S/I164A/C168K/ P170A/S202H/A211S/I245M/H255P/ R259K/R262T/V267I/T272A/T275S/ D296E/R300K/T312A/R324M/H343E/ V349T/N350E/R353E/I357C/L364R/ H366M/A380E/P384W/Q388A/P390* | + | + |
| 1021/1022 | L51E/T272A/S357C | H14T/R16Q/L19I/F33L/T39N/L48F/ L51E/V55I/A64N/V69I/T102S/L109G/ T118D/Y123F/D126A/T127S/I164A/ C168K/P170A/A211S/I245M/H255P/ R259K/R262T/V267I/T272A/T275S/ D296E/R300K/T312A/R324M/H343E/ V349T/N350E/R353D/I357C/L364R/ H366M/A380E/Q388A/P390* | ++ | + |
| 1023/1024 | L51E/F173I/T272A/ D353E/P384W | H14T/R16Q/L19I/F33L/T39N/L48F/ L51E/V55I/A64N/V69I/T102S/L109G/ T118D/Y123F/D126A/T127S/I164A/ C168K/P170A/F173I/A211S/I245M/ H255P/R259K/R262T/V267I/T272A/ T275S/D296E/R300K/T312A/R324M/ H343E/V349T/N350E/R353E/I357S/ L364R/H366M/A380E/P384W/Q388A/ P390* | + | ++ |
| 1025/1026 | D353E/P384W | H14T/R16Q/L19I/F33L/T39N/L48F/ V55I/A64N/V69I/T102S/L109G/T118D/ Y123F/D126A/T127S/I164A/C168K/ P170A/A211S/I245M/H255P/R259K/ R262T/V267I/T275S/D296E/R300K/ T312A/R324M/H343E/V349T/N350E/ R353E/I357S/L364R/H366M/A380E/ P384W/Q388A/P390* | ++ | + |

TABLE 12.2-continued

LDC Variants Based on SEQ ID NO: 888

| SEQ ID NO: (nt/aa) | Amino Acid Differences (Relative to SEQ ID NO: 888) | Amino Acid Differences (Relative to SEQ ID NO: 12) | Unchallenged Leu FIOP Relative to SEQ ID NO: 888[1] | Simulated GI Challenge, 5 AA Mix FIOP Relative to SEQ ID NO: 888[2] |
|---|---|---|---|---|
| 1027/1028 | S202H/T272A/S357C | H14T/R16Q/L19I/F33L/T39N/L48F/ V55I/A64N/V69I/T102S/L109G/T118D/ Y123F/D126A/T127S/I164A/C168K/ P170A/S202H/A211S/I245M/H255P/ R259K/R262T/V267I/T272A/T275S/ D296E/R300K/T312A/R324M/H343E/ V349T/N350E/R353D/I357C/L364R/ H366M/A380E/Q388A/P390* | ++ | + |
| 1029/1030 | N64S/R141P/F173I/ S202H/D353E/S357C | H14T/R16Q/L19I/F33L/T39N/L48F/ V55I/A64S/V69I/T102S/L109G/T118D/ Y123F/D126A/T127S/R141P/I164A/ C168K/P170A/F173I/S202H/A211S/ I245M/H255P/R259K/R262T/V267I/ T275S/D296E/R300K/T312A/R324M/ H343E/V349T/N350E/R353E/I357C/ L364R/H366M/A380E/Q388A/P39 | +++ | + |
| 1031/1032 | K5V/H41D/L51E/ S202H/S357C/A383S | K5V/H14T/R16Q/L19I/F33L/T39N/ H41D/L48F/L51E/V55I/A64N/V69I/ T102S/L109G/T118D/Y123F/D126A/ T127S/I164A/C168K/P170A/S202H/ A211S/I245M/H255P/R259K/R262T/ V267I/T275S/D296E/R300K/T312A/ R324M/H343E/V349T/N350E/R353D/ I357C/L364R/H366M/A380E/A383S/ Q388A/P390* | +++ | + |
| 1033/1034 | K5V/L51E/F173I/ T272A/A383S | K5V/H14T/R16Q/L19I/F33L/T39N/ L48F/L51E/V55I/A64N/V69I/T102S/ L109G/T118D/Y123F/D126A/T127S/ I164A/C168K/P170A/F173I/A211S/ I245M/H255P/R259K/R262T/V267I/ T272A/T275S/D296E/R300K/T312A/ R324M/H343E/V349T/N350E/R353D/ I357S/L364R/H366M/A380E/A383S/ Q388A/P390* | + | +++ |
| 1035/1036 | H41D/R141P/T272A | H14T/R16Q/L19I/F33L/T39N/H41D/ L48F/V55I/A64N/V69I/T102S/L109G/ T118D/Y123F/D126A/T127S/R141P/ I164A/C168K/P170A/A211S/I245M/ H255P/R259K/R262T/V267I/T272A/ T275S/D296E/R300K/T312A/R324M/ H343E/V349T/N350E/R353D/I357S/ L364R/H366M/A380E/Q388A/P390* | + | +++ |
| 1037/1038 | L51E/F173I | H14T/R16Q/L19I/F33L/T39N/L48F/ L51E/V55I/A64N/V69I/T102S/L109G/ T118D/Y123F/D126A/T127S/I164A/ C168K/P170A/F173I/A211S/I245M/ H255P/R259K/R262T/V267I/T275S/ D296E/R300K/T312A/R324M/H343E/ V349T/N350E/R353D/I357S/L364R/ H366M/A380E/Q388A/P390* | ++ | ++ |
| 1039/1040 | K5V/D353E | K5V/H14T/R16Q/L19I/F33L/T39N/ L48F/V55I/A64N/V69I/T102S/L109G/ T118D/Y123F/D126A/T127S/I164A/ C168K/P170A/A211S/I245M/H255P/ R259K/R262T/V267I/T275S/D296E/ R300K/T312A/R324M/H343E/V349T/ N350E/R353E/I357S/L364R/H366M/ A380E/Q388A/P390* | + | ++ |
| 1041/1042 | H41D/N64S/F173I/ T272A/D353E/A383S | H14T/R16Q/L19I/F33L/T39N/H41D/ L48F/V55I/A64S/V69I/T102S/L109G/ T118D/Y123F/D126A/T127S/I164A/ C168K/P170A/F173I/A211S/I245M/ H255P/R259K/R262T/V267I/T272A/ T275S/D296E/R300K/T312A/R324M/ H343E/V349T/N350E/R353E/I357S/ L364R/H366M/A380E/A383S/Q388A/ P390* | + | +++ |
| 1043/1044 | K5V/N64S/F173I/ T272A/D353E | K5V/H14T/R16Q/L19I/F33L/T39N/ L48F/V55I/A64S/V69I/T102S/L109G/ T118D/Y123F/D126A/T127S/I164A/ C168K/P170A/F173I/A211S/I245M/ H255P/R259K/R262T/V267I/T272A/ | + | +++ |

TABLE 12.2-continued

LDC Variants Based on SEQ ID NO: 888

| SEQ ID NO: (nt/aa) | Amino Acid Differences (Relative to SEQ ID NO: 888) | Amino Acid Differences (Relative to SEQ ID NO: 12) | Unchallenged Leu FIOP Relative to SEQ ID NO: 888[1] | Simulated GI Challenge, 5 AA Mix FIOP Relative to SEQ ID NO: 888[2] |
|---|---|---|---|---|
| 1045/1046 | L51E/N64S | T275S/D296E/R300K/T312A/R324M/ H343E/V349T/N350E/R353E/I357S/ L364R/H366M/A380E/Q388A/P390* H14T/R16Q/L19I/F33L/T39N/L48F/ L51E/V55I/A64S/V69I/T102S/L109G/ T118D/Y123F/D126A/T127S/I164A/ C168K/P170A/A211S/I245M/H255P/ R259K/R262T/V267I/T275S/D296E/ R300K/T312A/R324M/H343E/V349T/ N350E/R353D/I357S/L364R/H366M/ A380E/Q388A/P390* | + | ++ |
| 1047/1048 | H41D/S357C/A383S | H14T/R16Q/L19I/F33L/T39N/H41D/ L48F/V55I/A64N/V69I/T102S/L109G/ T118D/Y123F/D126A/T127S/I164A/ C168K/P170A/A211S/I245M/H255P/ R259K/R262T/V267I/T275S/D296E/ R300K/T312A/R324M/H343E/V349T/ N350E/R353D/I357C/L364R/H366M/ A380E/A383S/Q388A/P390* | +++ | + |
| 1049/1050 | H41D/F173I/D353E/ S357C | H14T/R16Q/L19I/F33L/T39N/H41D/ L48F/V55I/A64N/V69I/T102S/L109G/ T118D/Y123F/D126A/T127S/I164A/ C168K/P170A/F173I/A211S/I245M/ H255P/R259K/R262T/V267I/T275S/ D296E/R300K/T312A/R324M/H343E/ V349T/N350E/R353E/I357C/L364R/ H366M/A380E/Q388A/P390* | +++ | + |
| 1051/1052 | S202H/T272A/A383S | H14T/R16Q/L19I/F33L/T39N/L48F/ V55I/A64N/V69I/T102S/L109G/T118D/ Y123F/D126A/T127S/I164A/C168K/ P170A/S202H/A211S/I245M/H255P/ R259K/R262T/V267I/T272A/T275S/ D296E/R300K/T312A/R324M/H343E/ V349T/N350E/R353D/I357S/L364R/ H366M/A380E/A383S/Q388A/P390* | + | +++ |
| 1053/1054 | S202H/T272A | H14T/R16Q/L19I/F33L/T39N/L48F/ V55I/A64N/V69I/T102S/L109G/T118D/ Y123F/D126A/T127S/I164A/C168K/ P170A/S202H/A211S/I245M/H255P/ R259K/R262T/V267I/T272A/T275S/ D296E/R300K/T312A/R324M/H343E/ V349T/N350E/R353D/I357S/L364R/ H366M/A380E/Q388A/P390* | + | +++ |
| 1055/1056 | D353E/S357C | H14T/R16Q/L19I/F33L/T39N/L48F/ V55I/A64N/V69I/T102S/L109G/T118D/ Y123F/D126A/T127S/I164A/C168K/ P170A/A211S/I245M/H255P/R259K/ R262T/V267I/T275S/D296E/R300K/ T312A/R324M/H343E/V349T/N350E/ R353E/I357C/L364R/H366M/A380E/ Q388A/P390* | +++ | + |
| 1057/1058 | H41D/F173I/S202H/ T272A/S357C | H14T/R16Q/L19I/F33L/T39N/H41D/ L48F/V55I/A64N/V69I/T102S/L109G/ T118D/Y123F/D126A/T127S/I164A/ C168K/P170A/F173I/S202H/A211S/ I245M/H255P/R259K/R262T/V267I/ T272A/T275S/D296E/R300K/T312A/ R324M/H343E/V349T/N350E/R353D/ I357C/L364R/H366M/A380E/Q388A/ P390* | +++ | ++ |
| 1059/1060 | R141P/F173I/S202H/ T272A/D353E/S357C | H14T/R16Q/L19I/F33L/T39N/L48F/ V55I/A64N/V69I/T102S/L109G/T118D/ Y123F/D126A/T127S/R141P/I164A/ C168K/P170A/F173I/S202H/A211S/ I245M/H255P/R259K/R262T/V267I/ T272A/T275S/D296E/R300K/T312A/ R324M/H343E/V349T/N350E/R353E/ I357C/L364R/H366M/A380E/Q388A/ P390* | + | ++ |

TABLE 12.2-continued

LDC Variants Based on SEQ ID NO: 888

| SEQ ID NO: (nt/aa) | Amino Acid Differences (Relative to SEQ ID NO: 888) | Amino Acid Differences (Relative to SEQ ID NO: 12) | Unchallenged Leu FIOP Relative to SEQ ID NO: 888[1] | Simulated GI Challenge, 5 AA Mix FIOP Relative to SEQ ID NO: 888[2] |
|---|---|---|---|---|
| 1061/1062 | N64S/R141P/S202H | H14T/R16Q/L19I/F33L/T39N/L48F/ V55I/A64S/V69I/T102S/L109G/T118D/ Y123F/D126A/T127S/R141P/I164A/ C168K/P170A/S202H/A211S/I245M/ H255P/R259K/R262T/V267I/T275S/ D296E/R300K/T312A/R324M/H343E/ V349T/N350E/R353D/I357S/L364R/ H366M/A380E/Q388A/P390* | + | ++ |
| 1063/1064 | K5V/F173I/T272A | K5V/H14T/R16Q/L19I/F33L/T39N/ L48F/V55I/A64N/V69I/T102S/L109G/ T118D/Y123F/D126A/T127S/I164A/ C168K/P170A/F173I/A211S/I245M/ H255P/R259K/R262T/V267I/T272A/ T275S/D296E/R300K/T312A/R324M/ H343E/V349T/N350E/R353D/I357S/ L364R/H366M/A380E/Q388A/P390* | + | ++ |

[1]Levels of increased activity were determined relative to the reference polypeptide of SEQ ID NO: 888 and defined as follows: "+" .70 to 1.07 (first 50%), "++" > 1.07 (next 30%), "+++" > 1.36 (top 20%)
[2]Levels of increased activity were determined relative to the reference polypeptide of SEQ ID NO: 888 and defined as follows: "+" .47 to 1.00 (first 50%), "++" > 1.00 (next 30%), "+++" > 1.35 (top 20%)

Example 3

Pharmacodynamic (PD) Study of LDC Variants in the Intermediate MSUD Mouse Model

Intermediate Maple Syrup Urine Disease (iMSUD; Dbt$^{tm1Gch}$Tg(Cebpb-tTA)5Bjd Tg(tetO-DBT)A1Geh/J; Jackson Labs #006999) mice were subjected to leucine restriction (Research Diets #A05080202i leucine-free diet supplemented with 5.75 g/L leucine; Sigma #L8912) upon weaning to enhance health and extend survival. Once iMSUD mice reached ~20 g body weight (BW), eighteen naïve animals were randomized into groups for study (mixed-sex, 2-3.5 months old). Mice had ad libitum access to leucine-free diet and leucine-supplemented water throughout the study. Approximately 45 mg of whey (Grass Fed Whey Protein; BN Labs Lot #U0637AL; whey protein powder with 8.57% w/w leucine), suspended in 100 μL of water, was administered to each mouse by oral gavage. Following the whey protein meal, mice received either vehicle (20 mM sodium phosphate+0.4 mM PLP, pH 7.2) or enzyme (LDC of SEQ ID NO: 484, SEQ ID NO: 686, or SEQ ID NO: 766, dosed at 200 mg/kg, diluted in vehicle) via oral gavage (100 μL/animal). Blood was drawn through the tail vein at scheduled time points (pre-dose, and 15, 30, 60, 120, and 240 minutes post-dose). Plasma was extracted from the collected blood samples and analyzed by LC-MS to determine leucine levels using a standard curve (range: 2-3050 mM; LOQ: 2 μM).

Figure 1B:
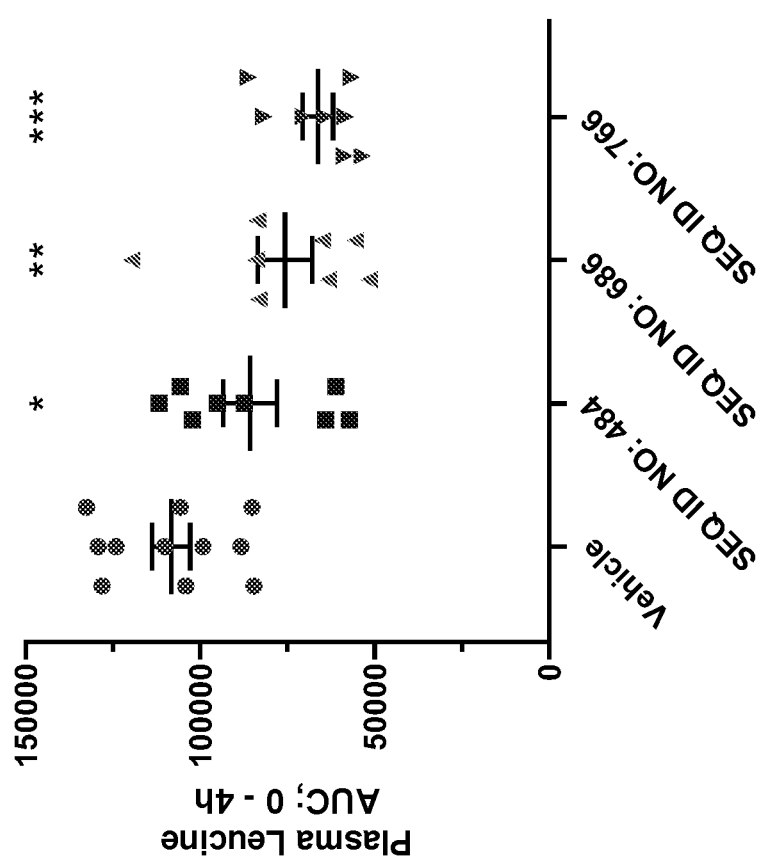

Following administration of the whey protein meal and vehicle, the mice had a significant increase in plasma leucine. Treatment with the engineered leucine decarboxylases immediately following whey significantly suppressed the leucine spike, showing enhanced suppression in more evolved variants in both time-course data (FIG. 1A) and area under the curve (AUC; FIG. 1B; suppression of 21% (p<0.05), 30% (p<0.01), or 39% (p<0.001) compared to vehicle with LDC of SEQ ID NO: 484, SEQ ID NO: 686, and SEQ ID NO: 766, respectively).

Example 4

Pharmacodynamic (PD) Dose-Response Study of LDC Polypeptide of SEQ ID NO: 766 in the iMSUD Mouse Model Thirteen non-naïve iMSUD mice from the prior study were randomized into groups (mixed-sex, 2.5-4 months old, ~20 g BW) after a minimum 2-week washout. Mice had ad libitum access to leucine-free diet and leucine-supplemented water (5.75 g/L leucine) throughout the study. Approximately 45 mg of whey (Grass Fed Whey Protein; BN Labs Lot #U0637AL; whey protein powder with 8.57% w/w leucine) suspended in 100 μL water was administered to each mouse by oral gavage. Following the whey protein meal, the mice received either vehicle (20 mM sodium phosphate+0.4 mM PLP, pH 7.2) or LDC of SEQ ID NO: 766 (50, 100, or 200 mg/kg diluted in vehicle) via oral gavage (100 μL/animal). Blood was drawn through the tail vein at scheduled time points (pre-dose, and 15, 30, 60, 120, and 240 minutes post-dose). Plasma was extracted from the collected blood samples and then analyzed by LC-MS to determine leucine, isoleucine, valine, phenylalanine, and methionine levels using respective standard curves (LOQ: 2 μM). Background (pre-dose) subtraction was done to correct for high baseline variance between animals.

Figure 2A:
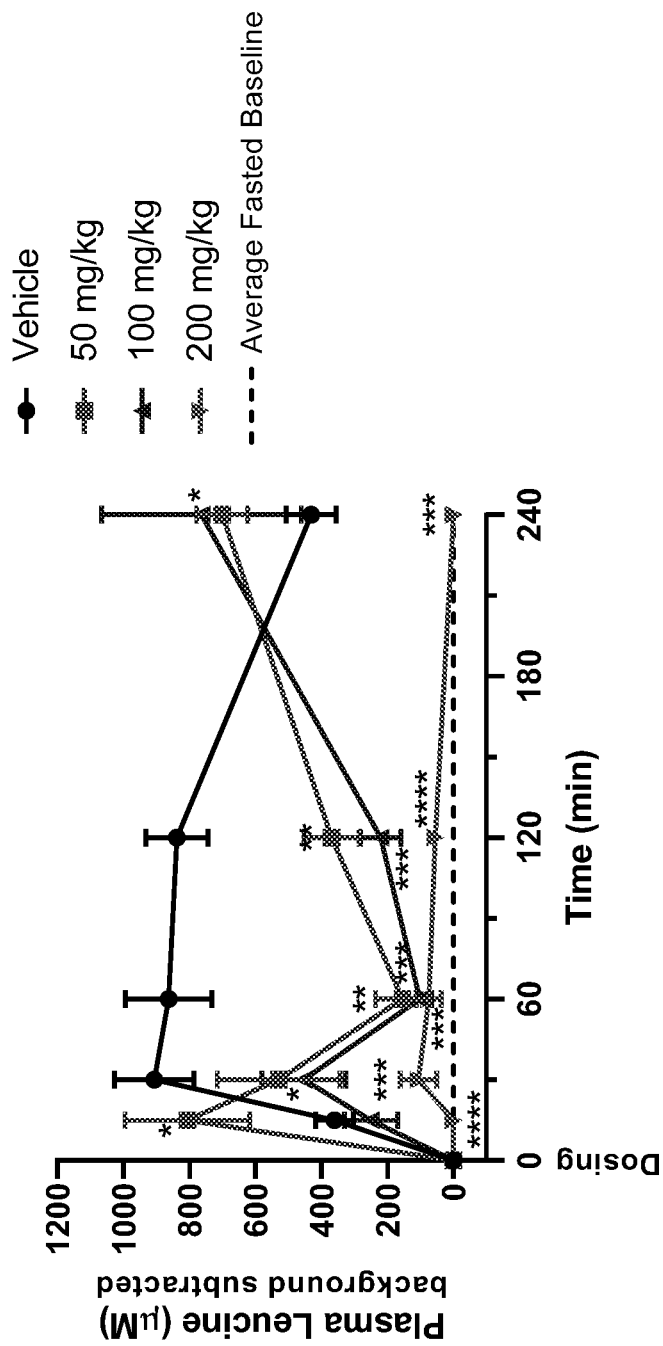
FIGS. 2A and 2B show results of pharmacodynamic (PD) dose-response study of LDC polypeptide of SEQ ID NO: 766 in the iMSUD mouse model. Treatment with differing amounts of engineered LDC polypeptide of SEQ ID NO: 766 following administration of whey protein meal results in dose dependent suppression of plasma leucine levels.
Figure 2B:
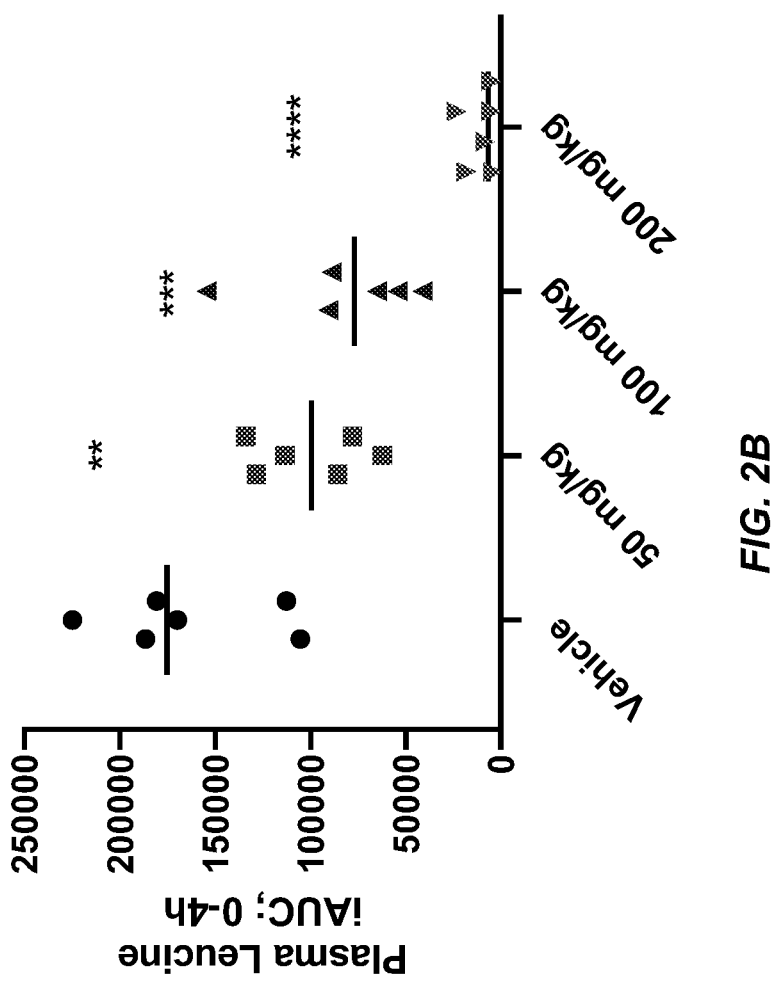

Following administration of the whey protein meal and vehicle, we observed a significant increase in plasma leucine. Treatment with all doses of LDC of SEQ ID NO: 766 immediately following whey significantly suppressed the leucine spike in a dose-responsive manner in both background subtracted time-course data (FIG. 2A) and incremental AUC (iAUC), which is the AUC calculated using background subtracted time-course data (FIG. 2B; compared to vehicle, a suppression of 40% (p<0.01), 57% (p<0.001) or 92% (p<0.0001) with 50, 100, and 200 mg/kg of LDC of SEQ ID NO: 766, respectively). Even though the whey protein meal produced a spike in other amino acids evaluated, LDC did not induce a suppression at any dose. The data for Average iAUC±SEM for several of the amino acids examined is provided in Table 13-1 below.

TABLE 13-1

Average iAUC ± SEM for Additional Amino Acids in the iMSUD Mouse Model with SEQ ID: 766 in Response to a Whey Protein Meal

| Amino Acid | Vehicle | 50 mg/kg | 100 mg/kg | 200 mg/kg |
| --- | --- | --- | --- | --- |
| Isoleucine | 28076 ± 11049 | 40165 ± 11169 | 41200 ± 5233 | 43649 ± 19828 |
| Valine | 65987 ± 22971 | 85452 ± 27259 | 92532 ± 18176 | 32635 ± 16084 |
| Methionine | 8178 ± 3754 | 11389 ± 4810 | 8736 ± 1469 | 9882 ± 4288 |
| Phenylalanine | 9327 ± 3701 | 12603 ± 5236 | 11228 ± 1051 | 6300 ± 2845 |

Example 5

Pharmacodynamic (PD) Dose-Response Study of an Evolved LDC Variant Compared to LDC Polypeptide of SEQ ID NO: 766 in the iMSUD Mouse Model Naïve iMSUD mice were subjected to leucine restriction (Research Diets #A05080202i leucine-free diet supplemented with 5.75 g/L leucine; Sigma #L8912) upon weaning to enhance health and extend survival. Twenty-four iMSUD mice, at least 20 g BW, were randomized into groups (mixed-sex, 2.5-6 months old) for study. Leucine-supplemented water (5.75 g/L) was changed to regular water ~40-60 minutes prior to the first blood collection and replaced following the final blood collection. Mice had ad libitum access to leucine-free diet and water throughout the study. Approximately 45 mg of whey (Grass Fed Whey Protein; BN Labs Lot #U0637AL; whey protein powder with 8.57% w/w leucine) suspended in 100 µL water was administered to each mouse by oral gavage. Following the whey protein meal, the mice received either vehicle (20 mM sodium phosphate+0.4 mM PLP, pH 7.2) or engineered leucine decarboxylase (SEQ ID NO: 766 or SEQ ID NO: 828 dosed at 100 mg/kg, diluted in vehicle) via oral gavage (100 µL/animal). Blood was drawn through the tail vein at scheduled time points (pre-dose, and 15, 30, 60, 120, and 240 minutes post-dose). Plasma was extracted from the collected blood samples and then analyzed by LC-MS to determine leucine, isoleucine, valine, phenylalanine, and methionine levels using respective standard curves (LOQ: 2 µM).

Figure 3A:
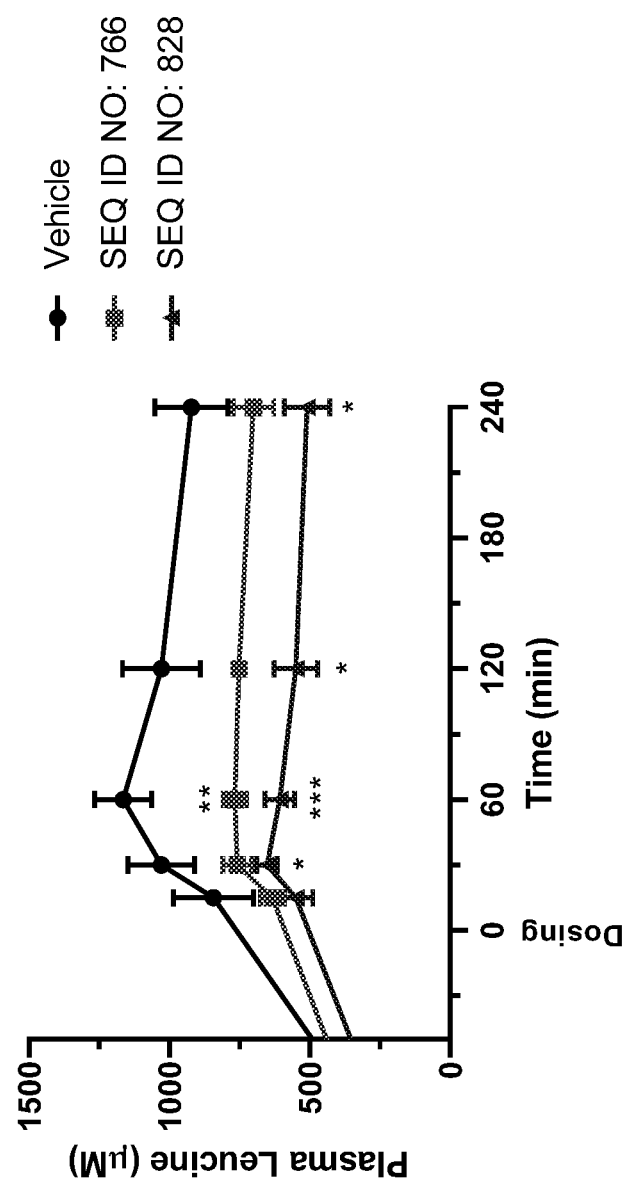
FIGS. 3A and 3B show results of a pharmacodynamic (PD) dose-response study comparing engineered LDC polypeptide of SEQ ID NO: 828 to engineered LDC polypeptide of SEQ ID NO: 766 in the iMSUD mouse model.
Figure 3B:
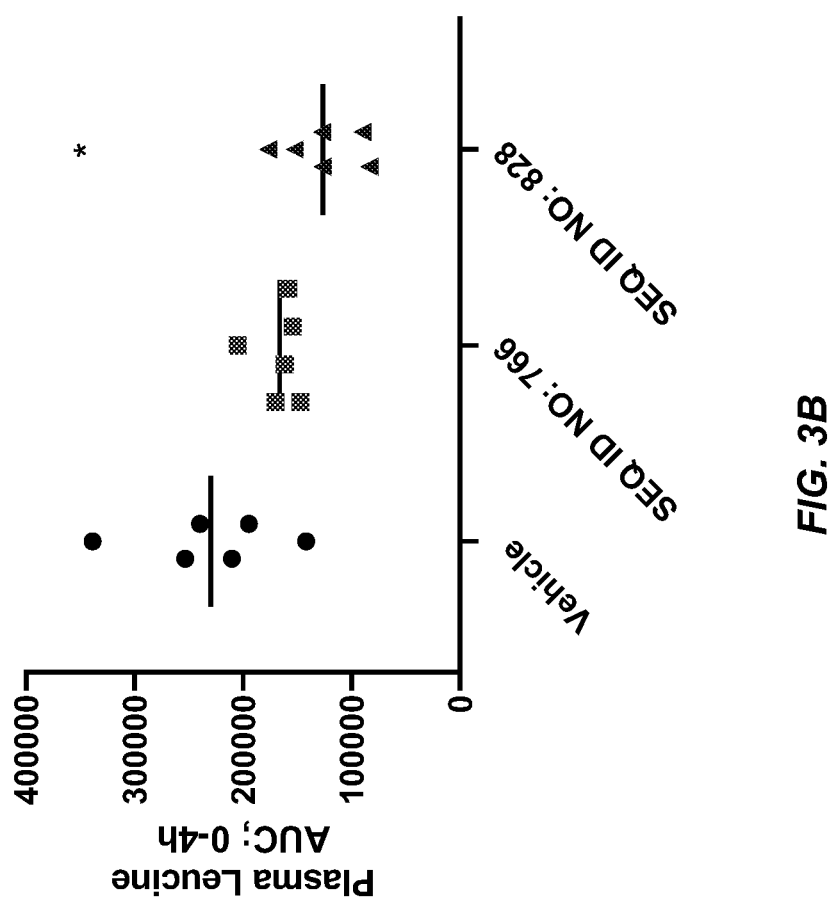

Following administration of the whey protein meal and vehicle, we observed a significant increase in serum leucine. Treatment with the engineered leucine decarboxylase immediately following whey significantly suppressed the leucine spike in both time-course data (FIG. 3A) and AUC (FIG. 3B; suppression of 28% (SEQ ID NO: 766) and 45% (SEQ ID NO: 828; p<0.05) compared to vehicle). Even though the whey protein meal produced a spike in other amino acids evaluated, LDC did not induce a suppression with either leucine decarboxylase variant. The data for Average iAUC±SEM for several of the amino acids examined is provided in Table 14-1 below.

TABLE 14-1

Average AUC ± SEM for Additional Amino Acids in the iMSUD Mouse Model LDC Variants in Response to a Whey Protein Meal

| Amino Acid | Vehicle | SEQ ID: 766 | SEQ ID: 828 |
| --- | --- | --- | --- |
| Isoleucine | 176704 ± 27189 | 117776 ± 9682 | 140237 ± 10582 |
| Valine | 593269 ± 78842 | 498331 ± 62289 | 447235 ± 63162 |
| Methionine | 32501 ± 1570 | 33915 ± 2631 | 39521 ± 1800 |
| Phenylalanine | 28983 ± 1751 | 25424 ± 1378 | 31054 ± 2649 |

Example 6

Pharmacodynamic (PD) Dose-Response Study of LDC Variants in Healthy Cynomolgus Monkeys Thirteen male cynomolgus monkeys were fasted overnight prior to dose administration. Approximately 10 g of whey (Grass Fed Whey Protein, BN Labs Lot #U0637AL; whey protein powder containing 8.57% w/w leucine) suspended in 20 mL water was administered via oral gavage to each monkey. Cynomolgus monkeys received either vehicle (20 mM sodium phosphate+0.4 mM PLP, pH 7.2) or an engineered leucine decarboxylase (SEQ ID NO: 484, SEQ ID NO: 686, or SEQ ID NO: 766 dosed at 25, 50, 100 mg/kg diluted in vehicle) via oral gavage as a suspension (2.5 mL/kg, 7.5-10 mL/animal). The standard diet (Certified Primate Chow 2055C; Envigo) was offered to all animals approximately 8 hours after treatment. Blood was collected via the femoral vein twice pre-dose (−1.5 hours and −30 minutes) and then at 5, 15, and 30 minutes, and 1, 2, 4, 8, 12, and 24 hours post-dose. Plasma was extracted from the collected blood samples and analyzed by LC-MS for levels of leucine, isoleucine, valine, phenylalanine, methionine, and tyrosine, against respective standard curves (LOQ: 4, 8, 8.5, 6, 7, and 11 µM, respectively).

Figure 4A:
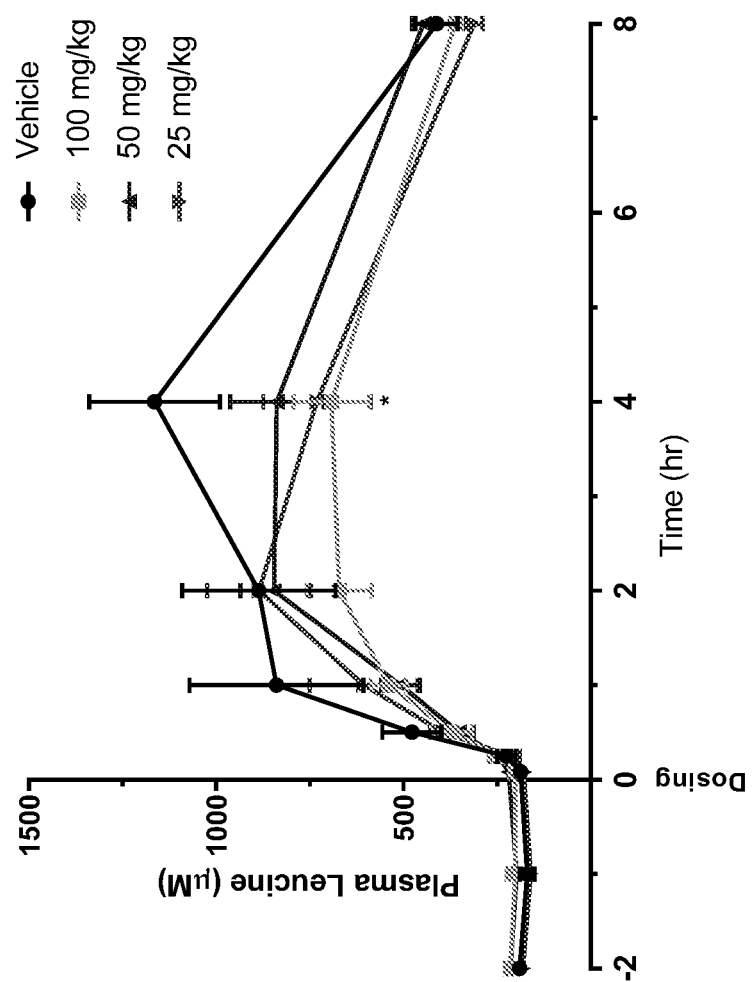
FIGS. 4A-4D shows pharmacodynamic (PD) dose-response study of engineered leucine decarboxylases in healthy cynomolgus monkeys.
Figure 4B:
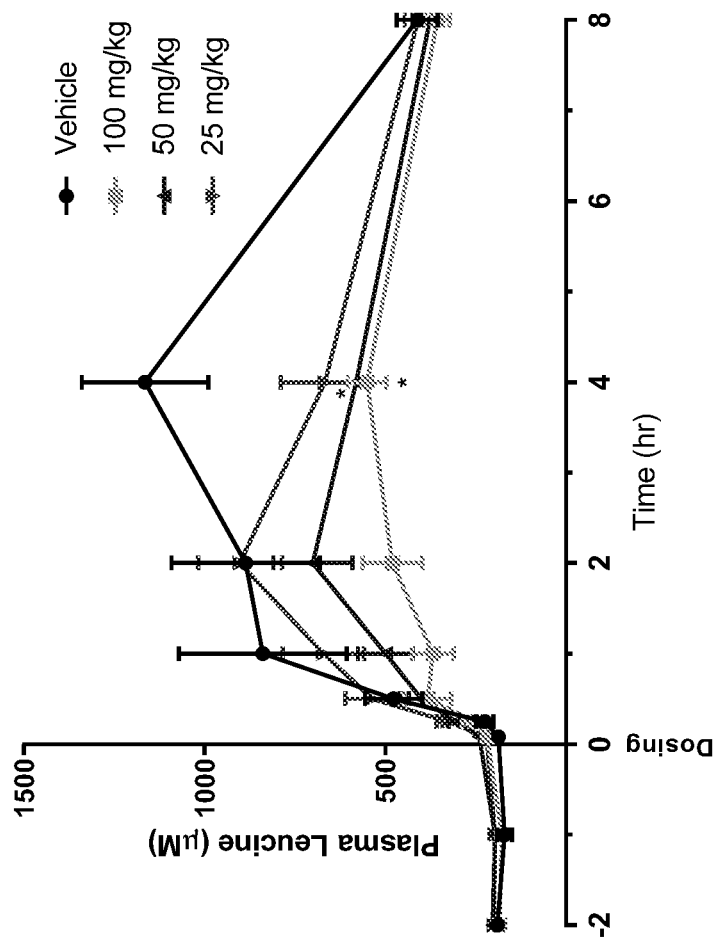
Figure 4C:
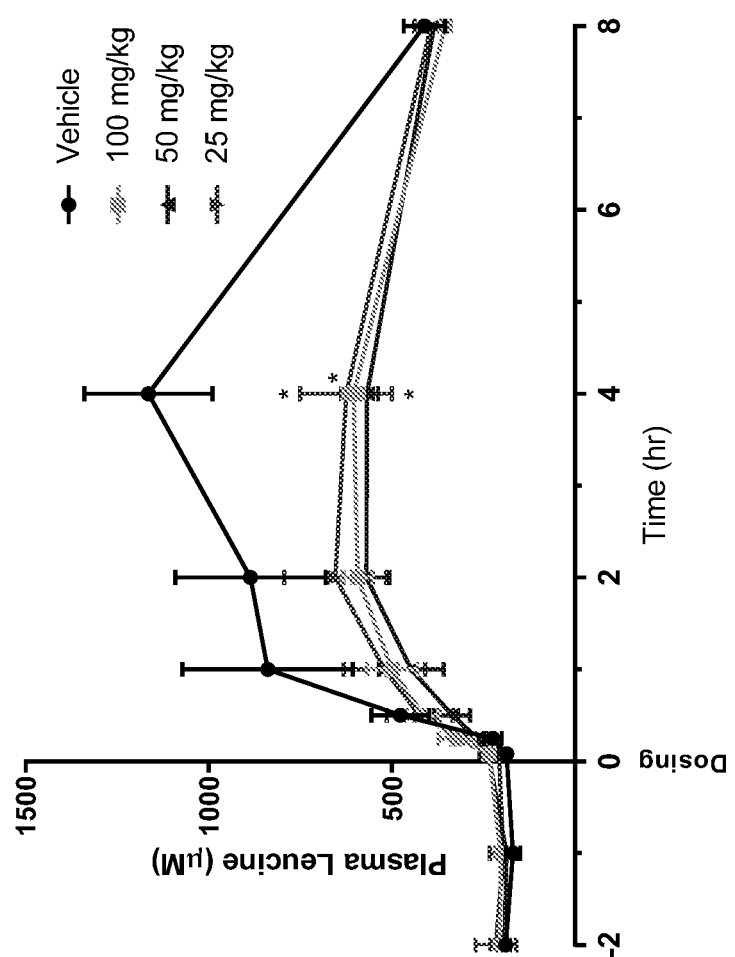
Figure 4D:
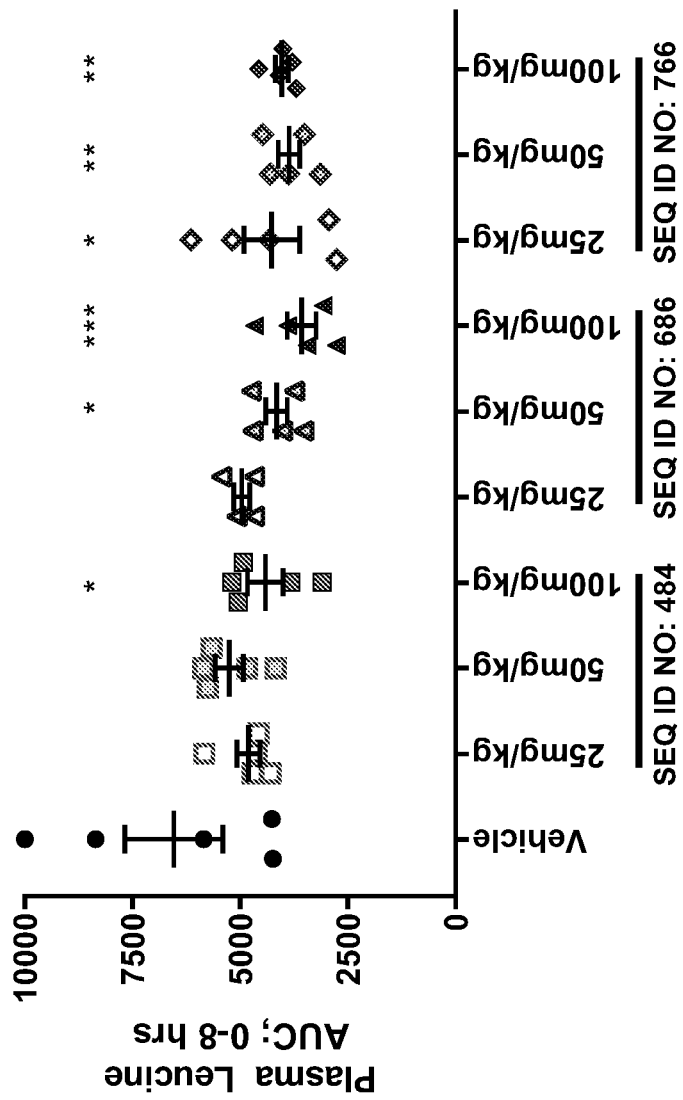

Administration of a whey meal by oral gavage, immediately followed by vehicle, resulted in an increase in leucine levels, to a maximum of approximately 1165 µM at the 4-hour time point. Treatment with LDC immediately following the whey protein meal suppressed the plasma leucine spike with all variants, showing enhanced suppression in more evolved variants in both time-course data (FIGS. 4A-4C) and AUC (FIG. 4D). The reduction in plasma leucine for the LDC variants are also provided in Table 15-1.

TABLE 15-1

% Reduction in Plasma Leucine in Healthy Cynomolgus Monkeys with LDC Variants in Response to a Whey Protein Meal (% Reduction in AUC Relative to Vehicle)

| SEQ ID NO: | 25 mg/kg | 50 mg/kg | 100 mg/kg |
| --- | --- | --- | --- |
| SEQ ID NO: 484 | 26 | 20 | 32 |
| SEQ ID NO: 686 | 24 | 36 | 45 |
| SEQ ID NO: 766 | 35 | 41 | 38 |

Even though the whey protein meal produced a spike in other amino acids evaluated, LDC did not induce a suppression at any dose. The data for Average AUC±SEM for some of the additional amino acids examined are provided in Tables 15-2, 15-3, and 15-4.

TABLE 15-2

Average AUC ± SEM for Additional Amino
Acids in Healthy Cynomolgus Monkeys with
SEQ ID: 484 in Response to a Whey Protein Meal

| Amino Acid | Vehicle | 25 mg/kg | 50 mg/kg | 100 mg/kg |
|---|---|---|---|---|
| Isoleucine | 3335 ± 438 | 2569 ± 208 | 3031 ± 160 | 2546 ± 236 |
| Valine | 4218 ± 273 | 3441 ± 311 | 3884 ± 127 | 3475 ± 311 |
| Methionine | 435 ± 88 | 412 ± 53 | 490 ± 51 | 393 ± 45 |
| Phenylalanine | 1150 ± 130 | 964 ± 49 | 1094 ± 69 | 987 ± 65 |

TABLE 15-3

Average AUC ± SEM for Additional Amino
Acids in Healthy Cynomolgus Monkeys with
SEQ ID: 686 in Response to a Whey Protein Meal

| Amino Acid | Vehicle | 25 mg/kg | 50 mg/kg | 100 mg/kg |
|---|---|---|---|---|
| Isoleucine | 3335 ± 438 | 2629 ± 105 | 2533 ± 140 | 2271 ± 245 |
| Valine | 4218 ± 601 | 3695 ± 227 | 3546 ± 184 | 3204 ± 390 |
| Methionine | 435 ± 88 | 496 ± 47 | 465 ± 52 | 322 ± 17 |
| Phenylalanine | 1150 ± 130 | 1025 ± 77 | 1095 ± 17 | 1025 ± 77 |

TABLE 15-4

Average AUC ± SEM for Additional Amino
Acids in Healthy Cynomolgus Monkeys with
SEQ ID: 766 in Response to a Whey Protein Meal

| Amino Acid | Vehicle | 25 mg/kg | 50 mg/kg | 100 mg/kg |
|---|---|---|---|---|
| Isoleucine | 3335 ± 438 | 2602 ± 412 | 2285 ± 177 | 2669 ± 156 |
| Valine | 4218 ± 601 | 3593 ± 514 | 3546 ± 184 | 3204 ± 390 |
| Methionine | 435 ± 88 | 381 ± 53 | 399 ± 53 | 464 ± 46 |
| Phenylalanine | 1150 ± 130 | 1086 ± 97 | 984 ± 37 | 1184 ± 58 |

Example 7

Pharmacodynamic (PD) Dose-Response and 3-Day Repeat Dose Studies with LDC Polypeptide of SEQ ID NO: 766 in Healthy Cynomolgus Monkeys Ten male cynomolgus monkeys were fasted overnight prior to dose administration. Approximately 10 g of whey (Grass Fed Whey Protein, BN Labs Lot #U0637AL; whey protein powder containing 8.57% w/w leucine) suspended in 20 mL water was administered via oral gavage to each monkey. Cynomolgus monkeys received either vehicle (20 mM sodium phosphate+0.4 mM PLP, pH 7.2) or LDC of SEQ ID NO: 766 (6.25, 12.5, and 25 mg/kg, diluted in vehicle) via oral gavage as a suspension (2.5 mL/kg, 7.5-10 mL/animal). The standard diet (Certified Primate Diet 5048; PMI) was offered to all animals approximately 8 hours after treatment. Blood was collected via the femoral vein at pre-dose and then at 5, 15, and 30 minutes, and 1, 2, 4, 8, 12, and 24 hours post-dose. Plasma was extracted from the collected blood samples and analyzed by LC-MS for levels of leucine, ketoisocaproic acid (KIC), isoleucine, valine, methionine, and phenylalanine against respective standard curves (LOQ: 15, 10, 10, 15, 5, and 10 µM, respectively).

Figure 5A:
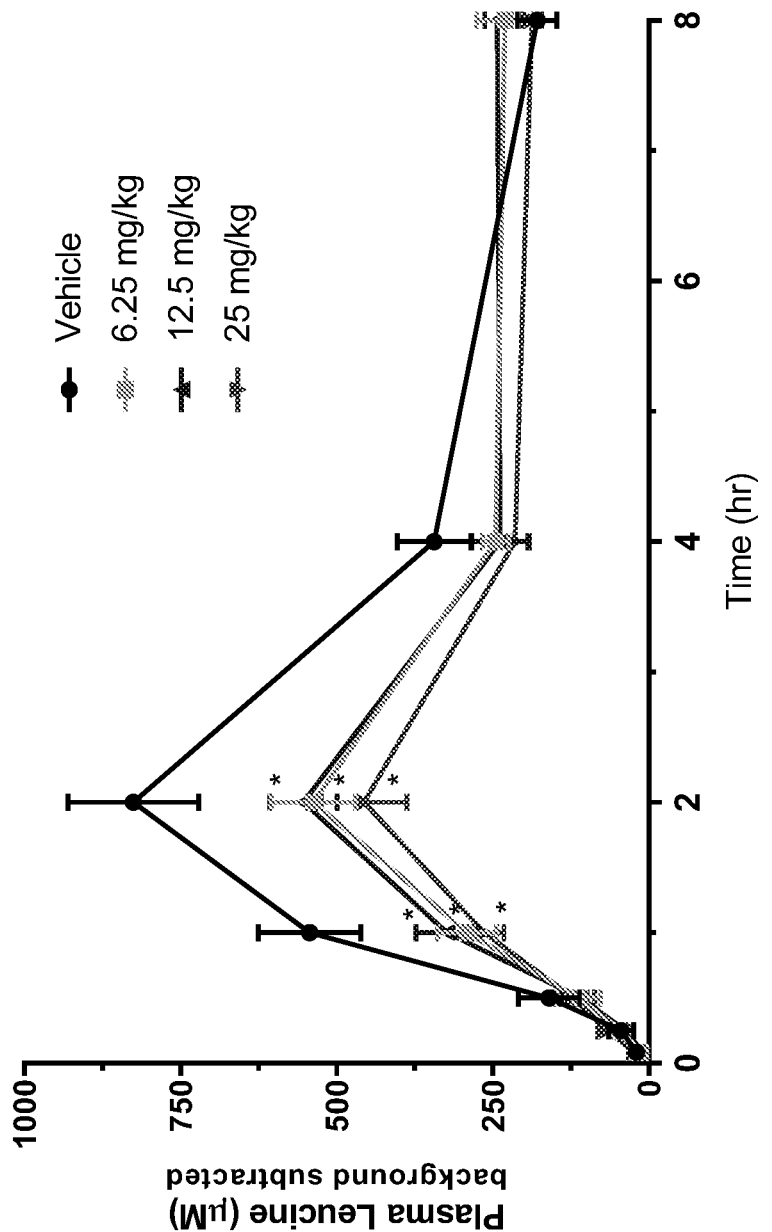
FIGS. 5A-5D show results of pharmacodynamic (PD) dose-response and 3-day repeat dose studies with an engineered LDC polypeptide of SEQ ID NO: 766 in healthy cynomolgus monkeys.
Figure 5B:
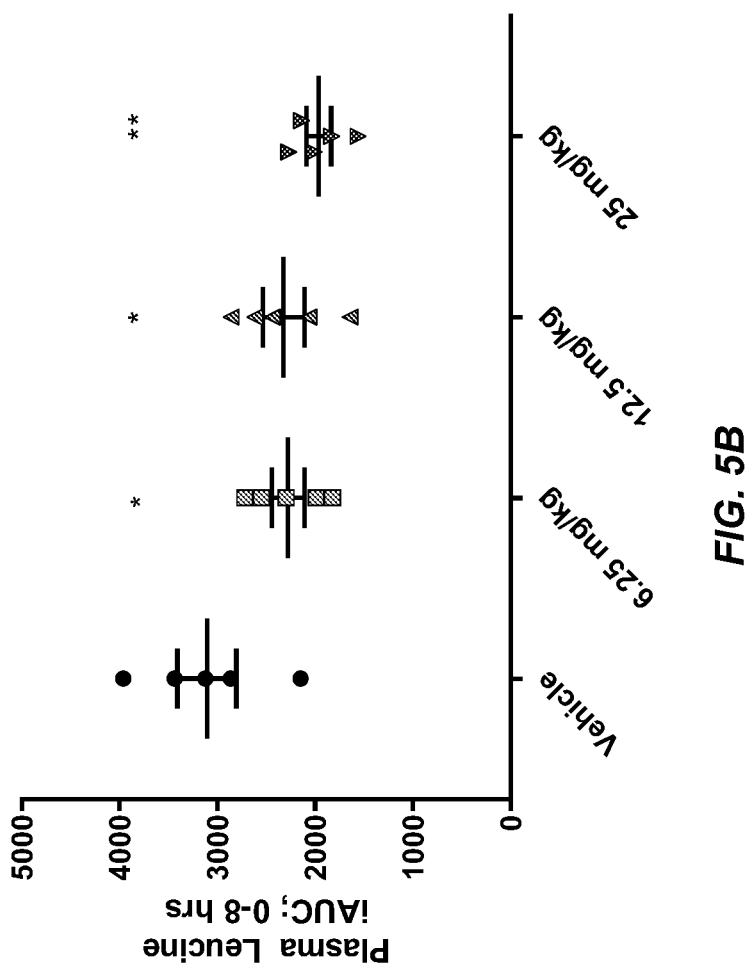
Figure 5C:
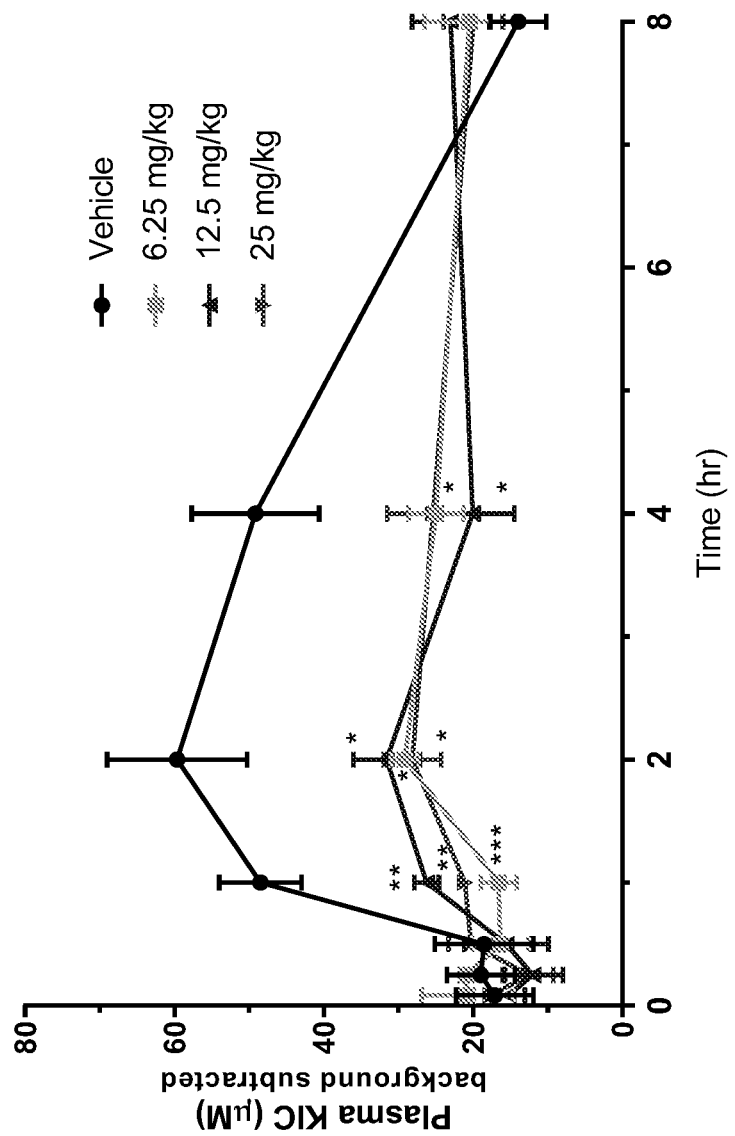
Figure 5D:
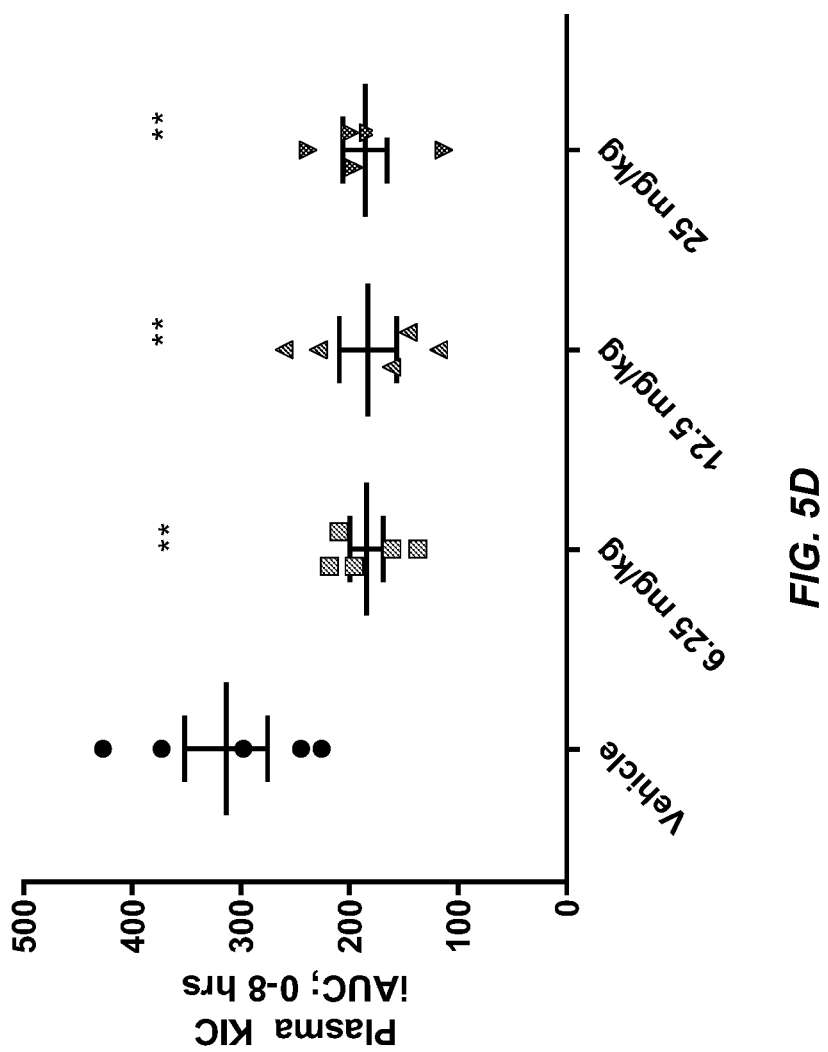

Administration of a whey meal by oral gavage, immediately followed by vehicle, resulted in an increase in leucine and KIC levels to a maximum of approximately 877 and 77 µM, respectively, at the 2-hour time point. Treatment with LDC of SEQ ID NO: 766 immediately following the whey protein meal significantly suppressed plasma leucine and MC spike for all doses in both background subtracted time-course data (FIGS. 5A and 5C) and iAUC (FIGS. 5B and 5D and Table 16-1).

TABLE 16-1

% Reduction in Plasma in Healthy Cynomolgus Monkeys
with SEQ ID: 766 in Response to a Whey Protein
Meal (% Reduction in iAUC Relative to Vehicle)

| Metabolite | 6.25 mg/kg | 12.5 mg/kg | 25 mg/kg |
|---|---|---|---|
| Leucine | 27 | 25 | 37 |
| KIC | 41 | 42 | 41 |

Even though a protein meal produced an increase in other amino acids evaluated, LDC did not induce suppression at any dose. The average iAUC for some of the amino acids examined are provided in Table 16-2.

TABLE 16-2

Average iAUC ± SEM for Additional Amino
Acids in Healthy Cynomolgus Monkeys with
SEQ ID: 766 in Response to a Whey Protein Meal

| Amino Acid | Vehicle | 6.25 mg/kg | 12.5 mg/kg | 25 mg/kg |
|---|---|---|---|---|
| Isoleucine | 1614 ± 171 | 1447 ± 93 | 1555 ± 138 | 1410 ± 129 |
| Valine | 2910 ± 331 | 2497 ± 219 | 2881 ± 286 | 2682 ± 293 |
| Methionine | 195 ± 33 | 129 ± 20 | 153 ± 26 | 147 ± 51 |
| Phenylalanine | 217 ± 31 | 189 ± 19 | 289 ± 38 | 293 ± 69 |

Following a three-week washout, all ten cynomolgus animals were re-randomized into two groups and fasted overnight prior to each daily dose administration. Approximately 10 g of whey protein meal suspended in 20 mL water was administered via oral gavage to each monkey. Cynomolgus monkeys received either vehicle (20 mM sodium phosphate+0.4 mM PLP, pH 7.2) or LDC of SEQ ID NO: 766 (25 mg/kg diluted in vehicle) via oral gavage as a suspension (2.5 mL/kg, 7.5-10 mL/animal). The standard diet (Certified Primate Diet 5048; PMI) was offered to all animals approximately 8 hours after treatment. This protocol was repeated for three consecutive days, with animals keeping the same group designation throughout the study. On each dosing day, blood was collected via the femoral vein at pre-dose and then at 1, 2, 4, 8, 12, and 24 (day 3 only) hours post-dose. Plasma was extracted from the collected blood samples and analyzed by LC-MS for levels of leucine, isoleucine, valine, methionine, and phenylalanine against respective standard curves (LOQ: 15, 10, 15, 5, and 10 µM, respectively).

Figure 6A:
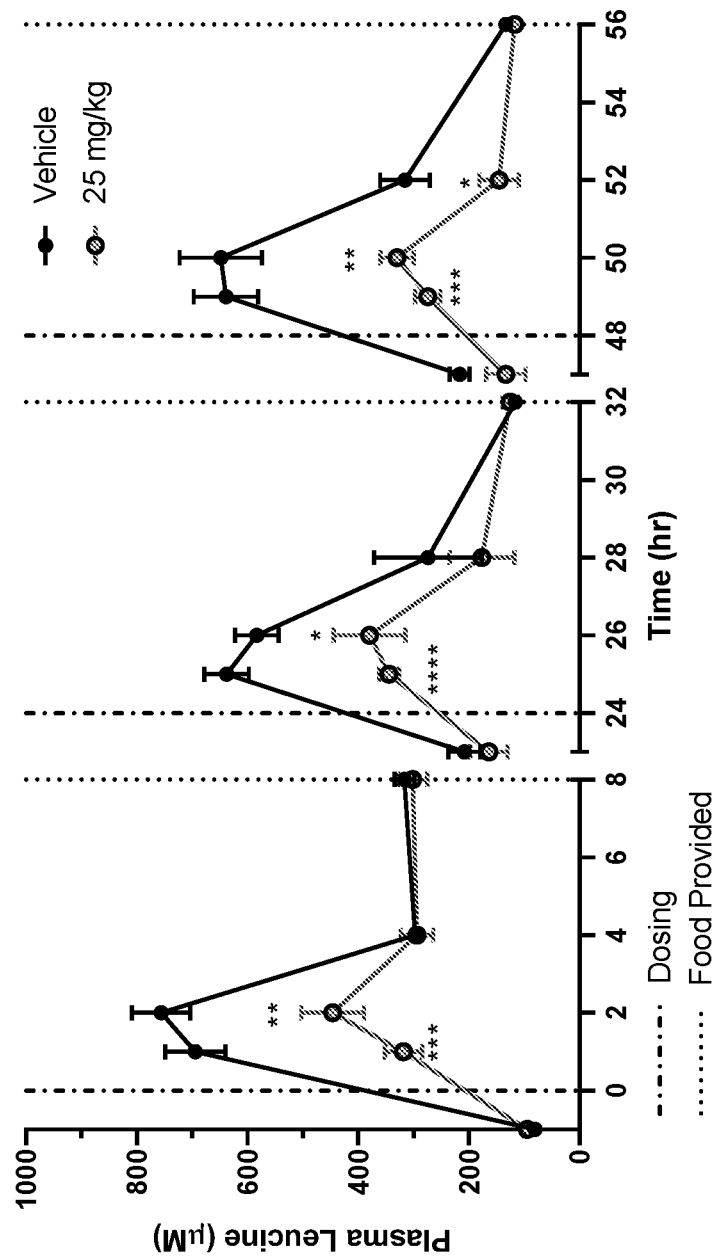
FIGS. 6A and 6B show results of study examining efficacy of engineered LDC polypeptide of SEQ ID NO: 766 against leucine in a whey protein meal in healthy cynomolgus monkeys in a consecutive 3-day challenge.
Figure 6B:
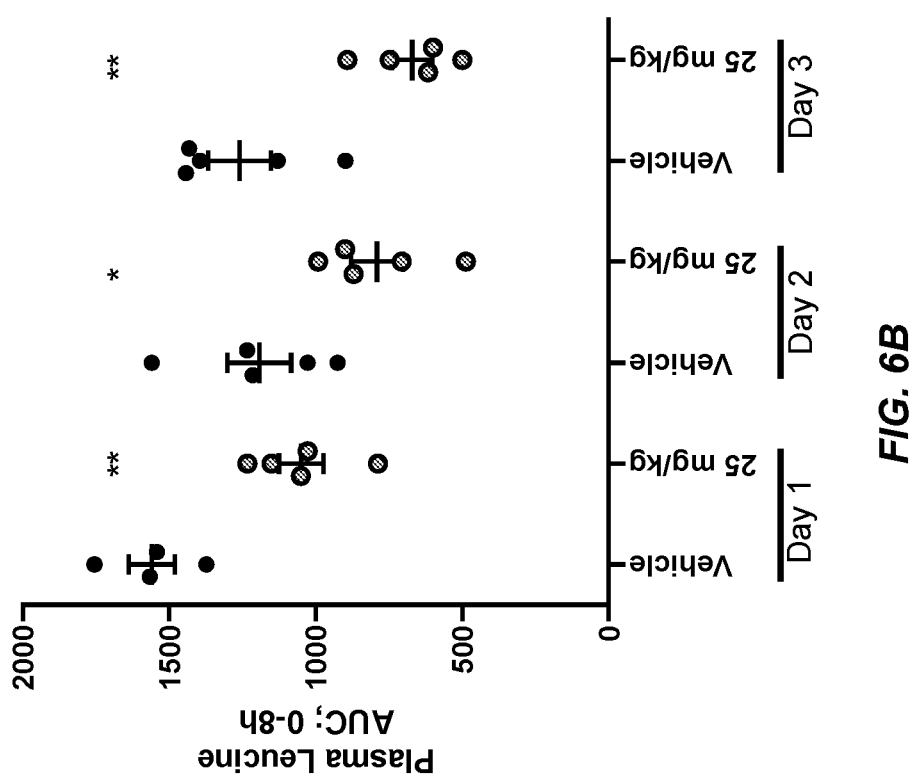
Figure 6C:
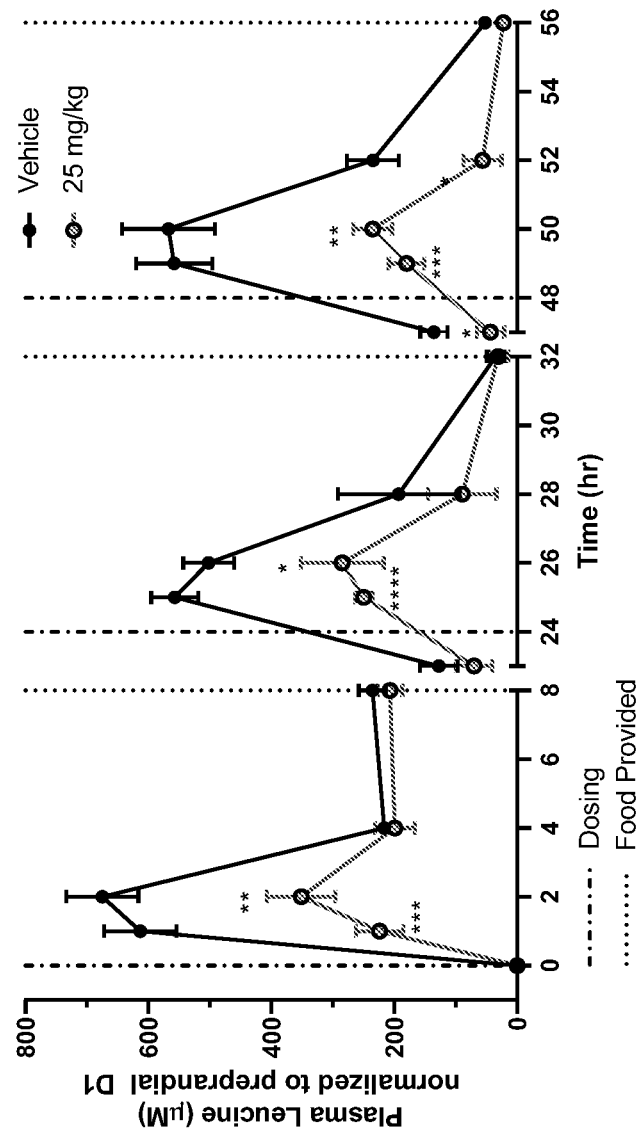
FIG. 6C** shows plasma leucine time course with baseline subtracted. Data is shown as mean±SEM; Multiple t-test *, p<0.05; , p<0.01; *, p<0.001; **, p<0.0001.
Figure 6D:
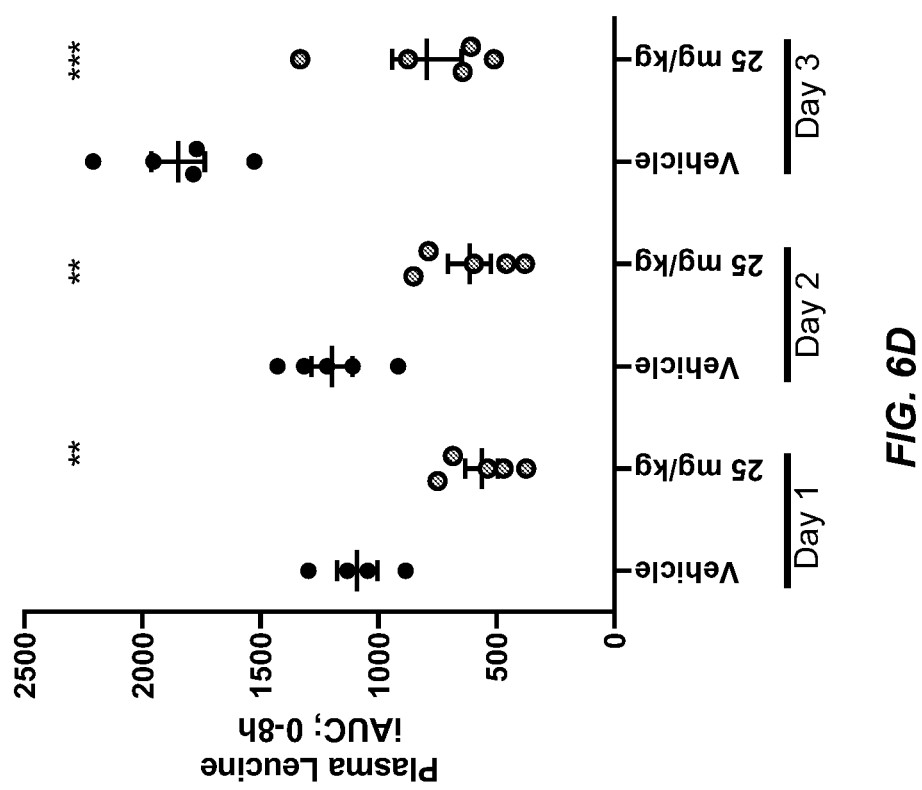
FIG. 6D** shows corresponding plasma leucine iAUC (baseline subtracted). Data is shown as mean±SEM; Unpaired t-test; Vehicle v. Treatment *, p<0.05; **, p<0.01.

Administration of a whey meal by oral gavage, immediately followed by vehicle, resulted in a similar increase in leucine 2 hours after dosing on each day (FIG. 6A). Treatment with LDC of SEQ ID NO: 766 immediately following the whey protein meal significantly suppressed plasma leucine on all days; increasing separation was observed between vehicle and treatment baseline with repeated dosing (day 2 and 3 pre-dose values; FIG. 6A) suggesting an additive effect. AUC data (FIG. 6B) also supported an additive effect of treatment, as the greatest reduction was observed on day 3 (47%), compared to 32% and 34% on days 1 and 2, respectively. To better assess baseline differences with repeated meal challenges, daily data were reanalyzed by baseline subtracting to the pre-meal value from day 1 (FIGS. 6C and 6D). Normalization better elucidated the increasing baseline with repeated meal challenge in the vehicle group as treatment-group baseline continued to reduce towards day 1 pre-meal baseline (FIG. 6C). The greatest effect of treatment was again seen on day 3 of the meal challenge (FIG. 6D). Table 16-3 also shows the % reduction in plasma leucine relative to vehicle.

TABLE 16-3

% Reduction in Plasma Leucine in Healthy Cynomolgus Monkeys with SEQ ID: 766 in Response to a Whey Protein Meal over 3 Consecutive Days (% Reduction Relative to Vehicle)

| Metabolite | Day 1 | Day 2 | Day 3 |
|---|---|---|---|
| Leucine (AUC) | 32 | 34 | 47 |
| Leucine (iAUC) | 48 | 49 | 57 |

Figure 7A:
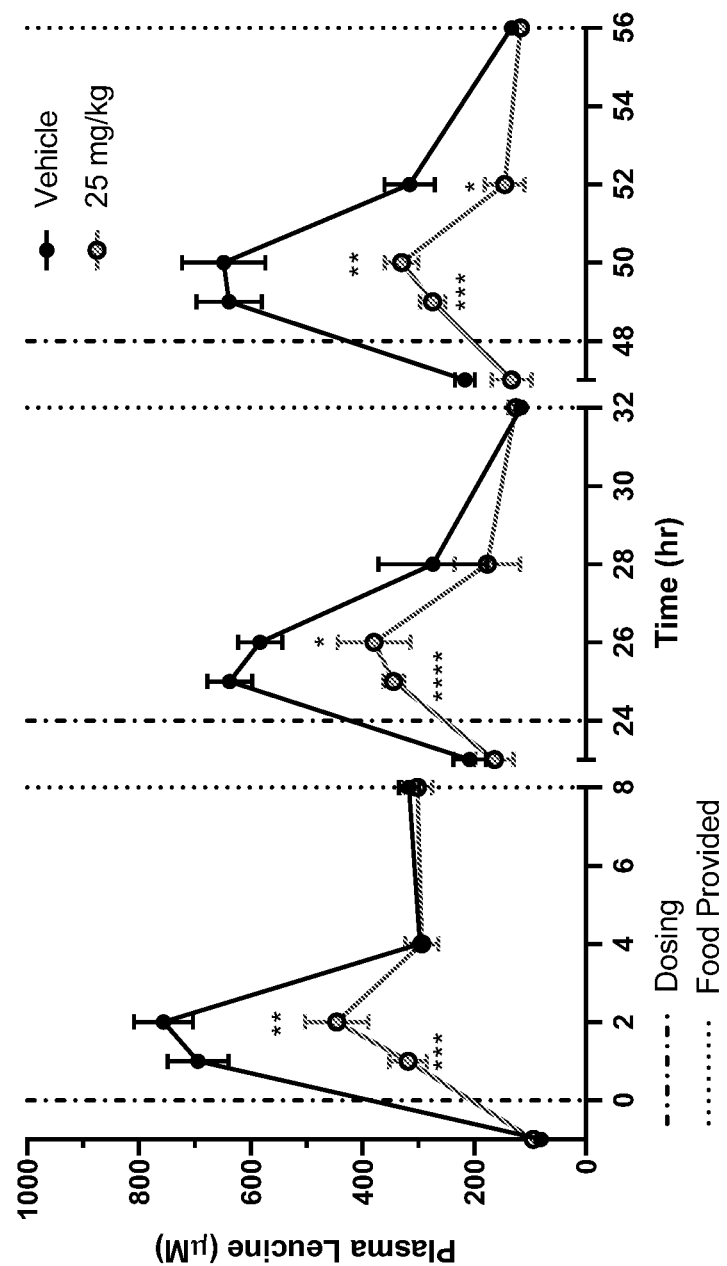
FIGS. 7A and 7B show results of study examining efficacy of the engineered LDC polypeptide of SEQ ID NO: 766 against methionine in a whey protein meal in healthy cynomolgus monkeys in a consecutive 3-day challenge.
Figure 7B:
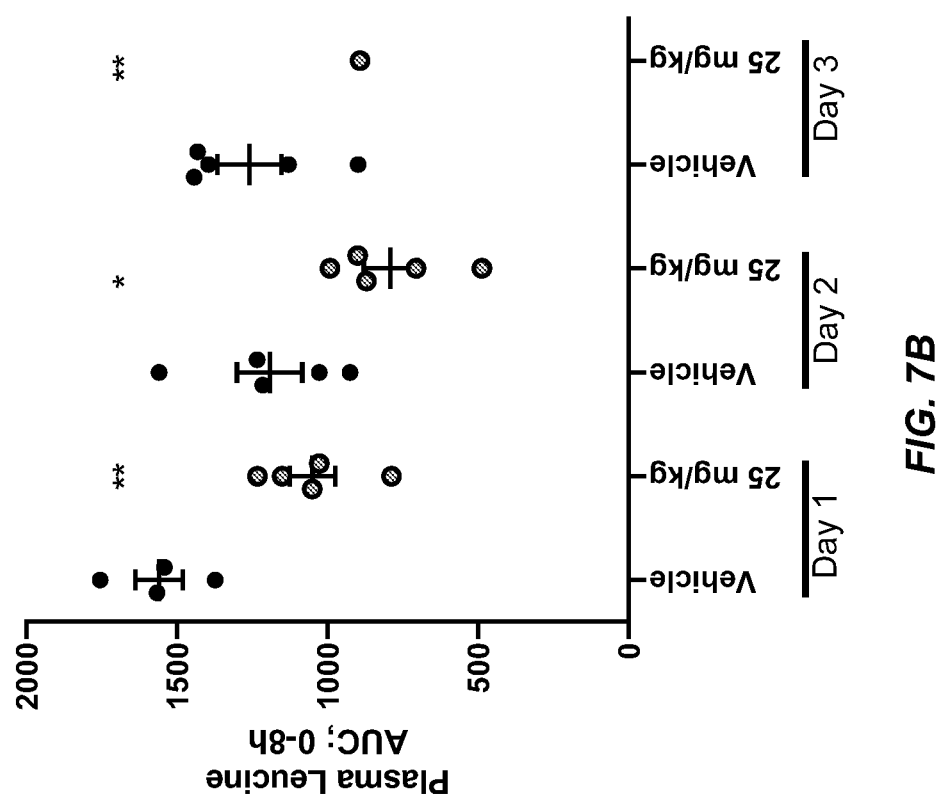

Though a protein meal produced an increase in other amino acids evaluated on all three days, LDC only induced a significant suppression on Day 3 of consecutive dosing (FIGS. 7A and 7B). The average iAUC±SEM for the additional amino acids examined are provided in Table 16-4.

TABLE 16-4

Average iAUC ± SEM for Additional Amino Acids in Healthy Cynomolgus Monkeys with SEQ ID: 766 in Response to a Whey Protein Meal

| Amino Acid | Day 1 (Vehicle:Treatment) | Day 2 (Vehicle:Treatment) | Day 3 (Vehicle:Treatment) |
|---|---|---|---|
| Isoleucine | 980 ± 124:903 ± 79 | 730 ± 99:604 ± 100 | 803 ± 67:508 ± 81 ($p < 0.05$) |
| Valine | 2110 ± 311:1914 ± 203 | 1772 ± 162:1300 ± 261 | 1875 ± 169:1054 ± 177 ($p < 0.05$) |
| Methionine | 62 ± 13:35 ± 5 | 201 ± 28:146 ± 20 | 156 ± 11:77 ± 13 ($p < 0.01$) |
| Phenylalanine | 120 ± 29:126 ± 26 | 157 ± 43:123 ± 27 | 127 ± 17:69 ± 18 ($p < 0.05$) |

Example 8

Pharmacodynamic (PD) Dose-Response Study of LDC of SEQ ID NO: 828 in the Intermediate MSUD Mouse Model Intermediate Maple Syrup Urine Disease (iMSUD; DbeniGeh Tg(Cebpb-tTA)5Bjd Tg(tetO-DBT)A1Geh/J; Jackson Labs #006999) mice were subjected to leucine restriction (Research Diets #A05080202i leucine-free diet supplemented with 5.75 g/L leucine; Sigma #L8912) upon weaning to enhance health and extend survival. Once iMSUD mice reached ~20 g body weight (BW), fourteen mice were randomized into groups for study (mixed-sex, 2-4.7 months old). Mice had ad libitum access to leucine-free diet and leucine-supplemented water throughout the study. Approximately 45 mg of whey protein powder (Grass Fed Whey Protein; BN Labs Lot #X01010AL0R; with 8.613% w/w leucine, 0% free amino acids), suspended in 100 μL of water, was administered to each mouse by oral gavage. Following the whey protein meal, mice received either vehicle (1 mM sodium phosphate +0.4 mM PLP, pH 7.5) or enzyme (SEQ ID NO: 828 dosed at 25, 50 and 100 mg/kg, diluted in vehicle without PLP) via oral gavage. The study design followed a 2-phase crossover with a two week washout in between. Blood was drawn through the tail vein at scheduled time points (pre-dose 30 mM, and post-dose 30, 60, 120, and 240 minutes). Plasma was extracted from the collected blood samples and analyzed by LC-MS/MS to determine leucine levels using a standard curve (range: 2-3050 mM; LOQ: 2 μM) to evaluate efficacy.

Figure 8A:
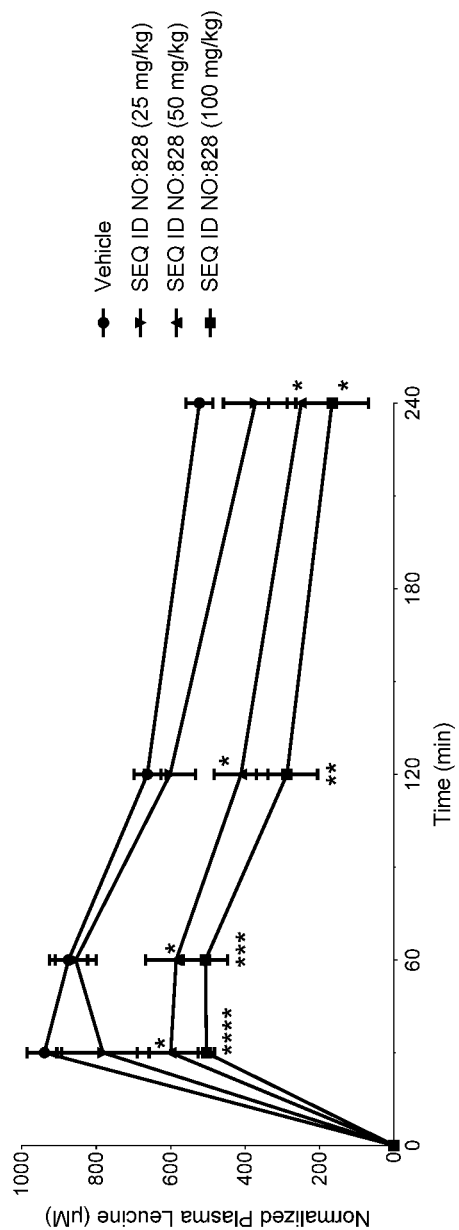
FIGS. 8A and 8B show results of a pharmacodynamic (PD) dose-response study of the effect of engineered LDC polypeptide in an intermediate MSUD mouse model. Treatment with three doses of engineered LDC (SEQ ID NO: 828) following administration of whey protein meal results in suppression of plasma leucine levels.
Figure 8B:
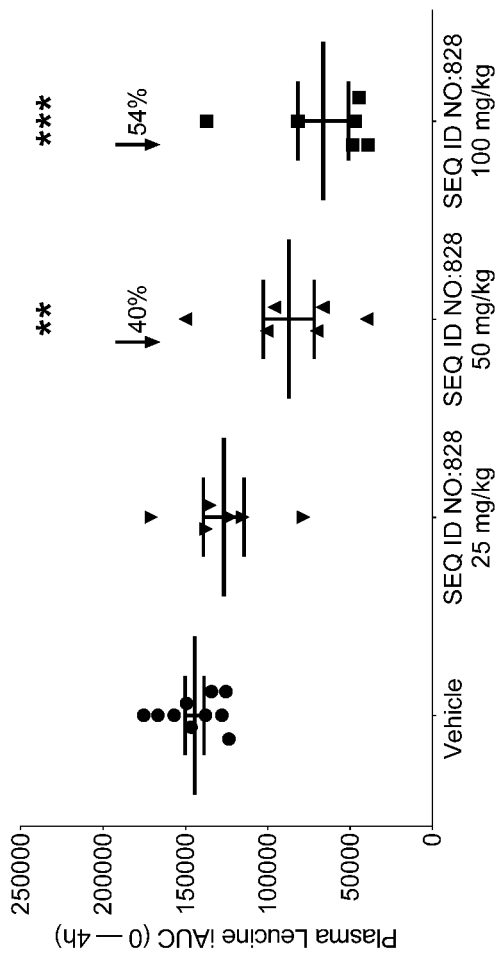

Following administration of the whey protein meal and vehicle, we observed a significant increase in plasma leucine levels. Treatment with LDC immediately following whey meal significantly suppressed the leucine spike in a dose dependent manner in both time-course data and area under the curve. Specifically, at all post-dose timepoints, there was a statistically significant suppression at the 100 mg/kg and 50 mg/kg doses compared to vehicle (FIG. 8A). Similarly, the incremental area under the curve (iAUC) data showed significant suppression of plasma leucine with SEQ ID NO: 828 treatment at 50 and 100 mg/kg by 40% and 54% respectively (FIG. 8B, Table 17). No statistically significant effect of treatment (iAUC) was observed in plasma levels of isoleucine, valine, methionine, or phenylalanine (Table 17). Statistical calculations and significance were determined using GraphPad Prism 9 (GraphPad Software).

TABLE 17

Average iAUC ± SEM for Plasma Analytes in the iMSUD Mouse Model with SEQ ID: 828 in Response to a Whey Protein Meal

| | Vehicle | 25 mg/kg | 50 mg/kg | 100 mg/kg |
|---|---|---|---|---|
| Leucine | 144432 ± 5632 | 126698 ± 12415 | 87260 ± 15453 | 66273 ± 15451 |
| Isoleucine | 21471 ± 4283 | 26433 ± 7408 | 33525 ± 10620 | 25370 ± 7595 |
| Valine | 42929 ± 8363 | 59330 ± 18124 | 83463 ± 24728 | 45120 ± 15444 |
| Methionine | 3309 ± 1166 | 2935 ± 1224 | 10353 ± 4708 | 5133 ± 3028 |
| Phenylalanine | 5996 ± 1737 | 4045 ± 1739 | 12810 ± 5897 | 5910 ± 3236 |

Example 9

Pharmacodynamic (PD) Dose-Response Study of SEQ ID NO: 828 in Healthy Cynomolgus Monkeys Twelve male cynomolgus monkeys were fasted overnight prior to dose administration. Approximately 10 g of whey protein powder (Grass Fed Whey Protein, BN Labs Lot #U06376AL; containing 8.63% w/w leucine) suspended in 20 mL water was administered via oral gavage to each monkey. Cynomolgus monkeys received either vehicle (1 mM sodium phosphate+0.4 mM PLP, pH 7.5) or enzyme (SEQ ID: 828 dosed at 6.25, 12.5 and 25 mg/kg diluted in vehicle without PLP) via oral gavage as a suspension (2.5 ml/kg). The study design followed a 2-phase crossover with a one week washout in between. The standard diet (Certified Primate Diet 5048, PMI Inc.) was offered to all animals approximately 8 hours after treatment. Blood was collected via the femoral vein twice pre-dose (1 and 2 hours) and then post-dose 5, 15, and 30 minutes, and 1, 2, 4, 8, and 24 hours post-dose. Plasma was extracted from the collected blood samples and analyzed by LC-MS/MS for levels of leucine, isoleucine, valine, phenylalanine, and methionine, against respective standard curves (LOQ: 4, 8, 8.5, 6, and 7 µM respectively).

Administration of a whey meal by oral gavage, immediately followed by vehicle, resulted in an increase in leucine levels. Treatment with LDC immediately following the whey protein meal suppressed the plasma leucine spike in a dose-dependent manner, showing statistically significant suppression at 25 mg/kg in the time-course data (FIG. 9A). This also resulted in statistically significant suppression of plasma leucine iAUC at 12.5 mg/kg (24%) and 25 mg/kg (37%) (FIG. 9B). Although the whey protein meal produced a spike in other amino acids evaluated, LDC did not induce a statistically significant effect in iAUC in plasma levels of isoleucine, valine, methionine, or phenylalanine with the treatment (Table 18). Statistical calculations and significance were determined using GraphPad Prism 9 (GraphPad Software).

TABLE 18

Average iAUC ± SEM for Plasma Analytes in healthy NHPs with SEQ ID: 828 in Response to a Whey Protein Meal

|  | Vehicle | 6.25 mg/kg | 12.5 mg/kg | 25 mg/kg |
|---|---|---|---|---|
| Leucine | 5690 ± 286 | 4998 ± 196 | 4324 ± 404 | 3571 ± 187 |
| Isoleucine | 3614 ± 200 | 3573 ± 125 | 3389 ± 322 | 2972 ± 241 |
| Valine | 7843 ± 619 | 8176 ± 259 | 7650 ± 846 | 6619 ± 658 |
| Methionine | 105 ± 24 | 142 ± 33 | 106 ± 30 | 108 ± 29 |
| Phenylalanine | 401 ± 41 | 391 ± 28 | 419 ± 65 | 441 ± 79 |

Example 10

Confirmation of Pharmacodynamic (PD) Dose-Response Study of SEQ ID NO: 828 in Healthy Cynomolgus Monkeys Fifteen male cynomolgus monkeys were fasted overnight prior to dose administration. Approximately 10 g of whey protein powder (Grass Fed Whey Protein, BN Labs Lot #X01010AL0R; containing 8.63% w/w leucine) suspended in 20 mL water was administered via oral gavage to each monkey. Cynomolgus monkeys received either vehicle (1 mM sodium phosphate+0.4 mM PLP, pH 7.5) or enzyme (SEQ ID: 828 dosed at 3.125, 6.25, 12.5 and 25 mg/kg diluted in vehicle without PLP) via oral gavage as a suspension (2.5 mL/kg). The study design followed a 2-phase crossover with a one week washout in between. The standard diet (Certified Primate Diet 5048, PMI Inc.) was offered to all animals approximately 8 hours after treatment. Blood was collected via the femoral vein twice pre-dose (1 and 2 hours) and then post-dose 5, 15, and 30 minutes, and 1, 2, 4, 8, and 24 hours post-dose. Plasma was extracted from the collected blood samples and analyzed by LC-MS/MS for levels of leucine, isoleucine, valine, phenylalanine, and methionine, against respective standard curves (LOQ: 4, 8, 8.5, 6, and 7 µM respectively).

Figure 10A:
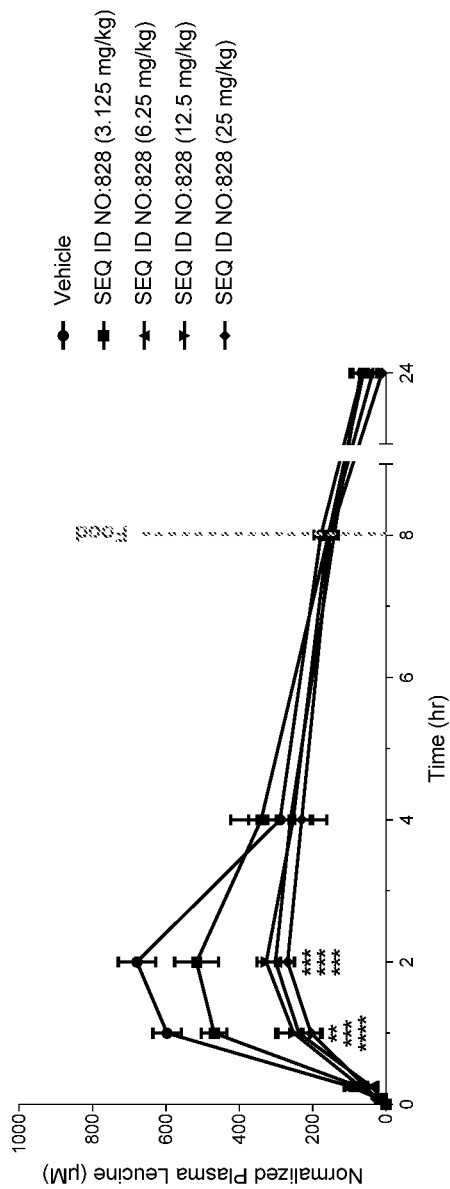
FIGS. 10A and 10B show results of a pharmacodynamic (PD) study of the effect of engineered LDC in healthy cynomolgus monkeys. Treatment with three doses of engineered LDC (SEQ ID NO: 828) following administration of whey protein meal results in suppression of plasma leucine and KIC levels.
Figure 10B:
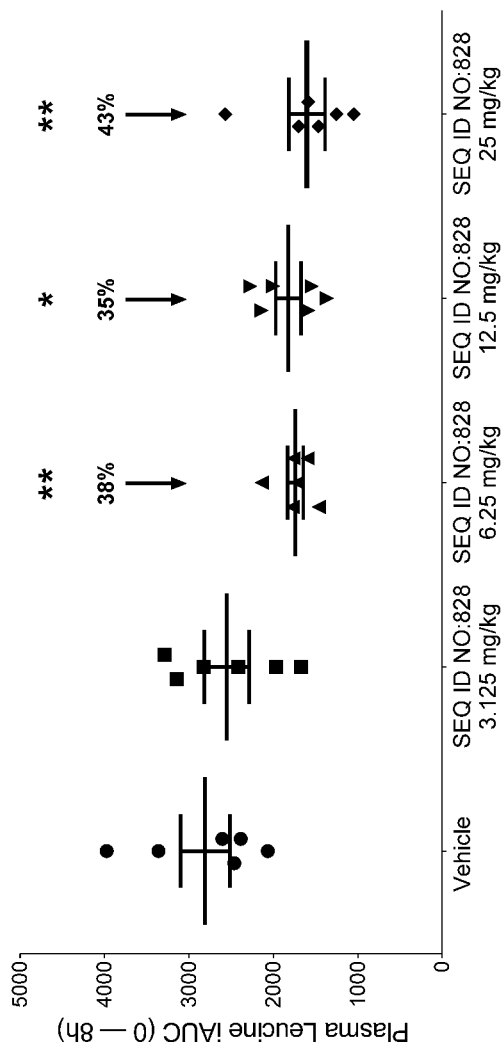

Administration of a whey meal by oral gavage, immediately followed by vehicle, resulted in an increase in leucine levels. Treatment with LDC immediately following the whey protein meal suppressed the plasma leucine spike in a dose-dependent manner, showing statistically significant suppression at 6.25, 12.5 and 25 mg/kg in the time-course data at 1 and 2 hours post-dose (FIG. 10A). Similarly, this resulted in a statistically significant suppression of plasma leucine iAUC at 6.25 mg/kg (38%), 12.5 mg/kg (35%) and 25 mg/kg (43%) (FIG. 10B). The LDC treatment also caused a dose dependent suppression of KIC reaching statistical significance at 25 mg/kg dose. Although the whey protein meal produced a spike in other amino acids evaluated, LDC did not induce a statistically significant effect in iAUC for isoleucine, valine, methionine, or phenylalanine with treatment (Tables 19). Statistical calculations and significance were determined using GraphPad Prism 9 (GraphPad Software).

TABLE 19

Average iAUC ± SEM for Plasma Analytes in healthy NHPs with SEQ ID: 828 in Response to a Whey Protein Meal

|  | Vehicle | 3.125 mg/kg | 6.25 mg/kg | 12.5 mg/kg | 25 mg/kg |
|---|---|---|---|---|---|
| Leucine | 2811 ± 291 | 2554 ± 265 | 1741 ± 93 | 1822 ± 151 | 1605 ± 215 |
| KIC | 301 ± 43 | 234 ± 29 | 202 ± 29 | 207 ± 15 | 177 ± 30 |
| Isoleucine | 1626 ± 157 | 1665 ± 125 | 1385 ± 66 | 1392 ± 116 | 1343 ± 129 |
| Valine | 2604 ± 264 | 2737 ± 232 | 2216 ± 134 | 2300 ± 209 | 2233 ± 229 |
| Methionine | 84 ± 16 | 119 ± 35 | 93 ± 17 | 69 ± 8 | 59 ± 13 |
| Phenylalanine | 224 ± 37 | 270 ± 36 | 207 ± 15 | 238 ± 15 | 227 ± 36 |

Example 11

Pharmacodynamic (PD) 3-Day Repeat Dose Study with SEQ ID: 828 in Healthy Cynomolgus Monkeys Twelve male cynomolgus monkeys were divided into two groups (n=6) and fasted overnight prior to each daily dose administration in a 3-day repeat dose study design. Approximately 10 g of whey protein meal (Grass Fed Whey Protein, BN Labs Lot #X01010AL0R; containing 8.63% w/w leucine) suspended in 20 mL water was administered via oral gavage to each monkey. Cynomolgus monkeys received either vehicle (1 mM sodium phosphate+0.4 mM PLP, pH 7.5) or SEQ ID: 828 (6.25 mg/kg diluted in vehicle without PLP) via oral gavage as a suspension (2.5 mL/kg). The standard diet (Certified Primate Diet 5048; PMI Inc.) was offered to all animals approximately 8 hours after treatment. This protocol was repeated for three consecutive days, with animals keeping the same group designation throughout the study. On each dosing day, blood was collected via the femoral vein at 1 hour pre-dose and then at 1, 2, 4, 8, 12, and 24 (day 3 only) hours post-dose. Plasma was extracted from the collected blood samples and analyzed by LC-MS/MS for levels of leucine, isoleucine, valine, methionine, and phenylalanine against respective standard curves (LOQ: 15, 10, 15, 5, and 10 μM, respectively).

Figure 11A:
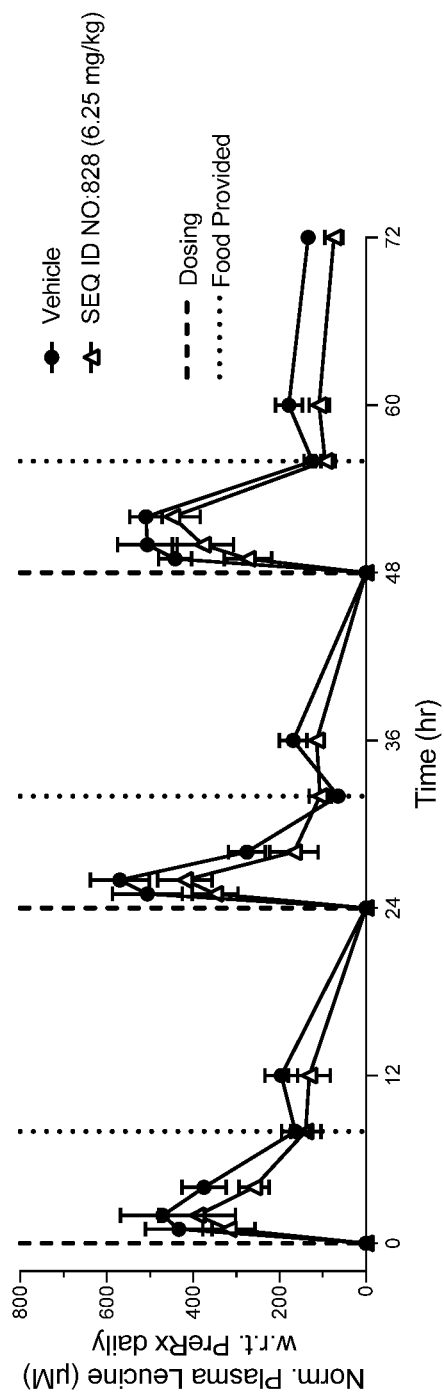
FIGS. 11A, 11B, and 11C show results of a pharmacodynamic (PD) 3-day repeat dose study of the effect of engineered leucine decarboxylase (LDC) in healthy cynomolgus monkeys. Treatment with a low dose (6.25 mg/kg) of engineered LDC (SEQ ID NO: 828) following administration of whey protein meal results in suppression of plasma leucine and KIC levels.
Figure 11B:
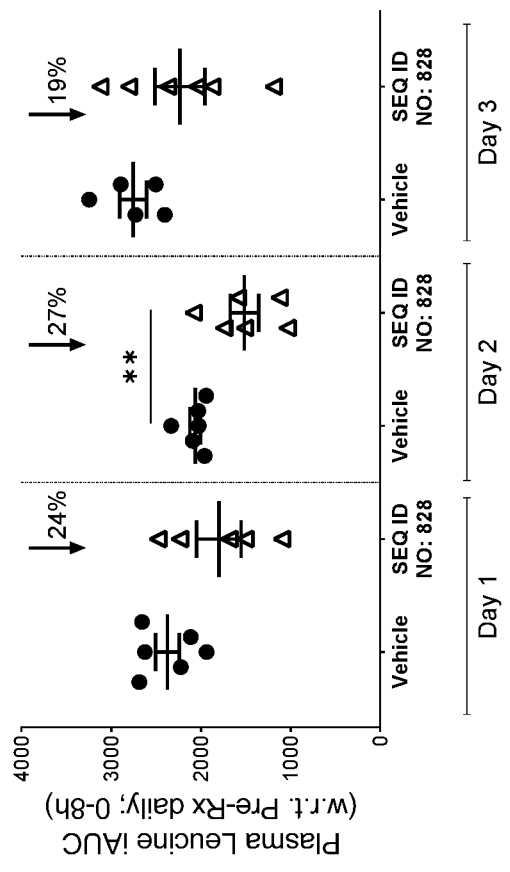
Figure 11C:
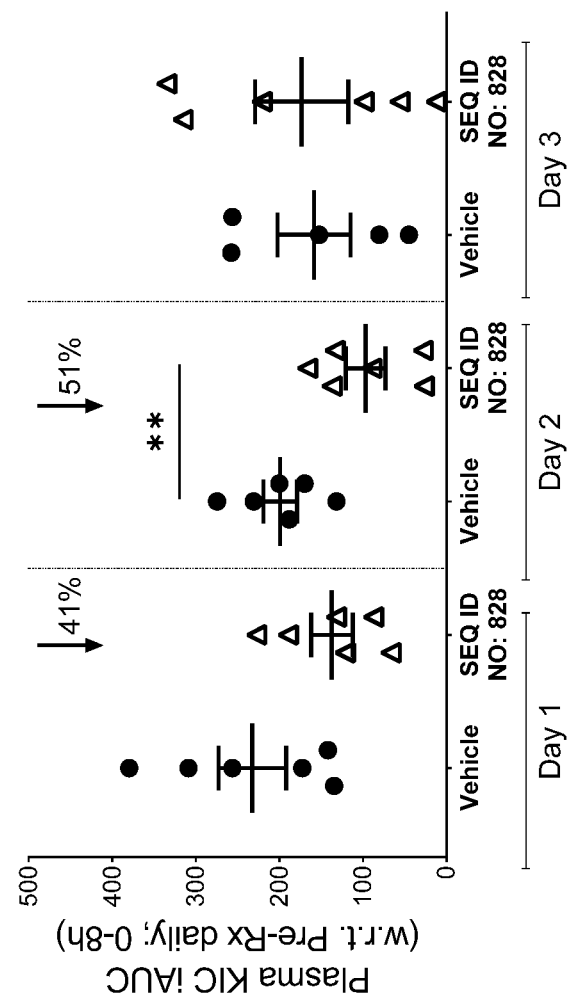

Administration of a whey meal by oral gavage, immediately followed by vehicle, resulted in a similar increase in leucine 1-2 hours after dosing on each day (FIG. 11A). Treatment with SEQ ID: 828 immediately following the whey protein meal similarly suppressed plasma leucine over the time course, on all days but did not reach statistical significance. LDC caused a significant suppression in plasma leucine and KIC in iAUC data (Table 20, FIGS. 11B and 11C) on day 2. Although the whey protein meal produced a spike in other amino acids evaluated, LDC did not induce a statistically significant effect in iAUC for isoleucine, valine, methionine, or phenylalanine (Table 21). Statistical calculations and significance were determined using GraphPad Prism 9 (GraphPad Software).

TABLE 20

% Reduction in Plasma Analytes in Healthy Cynomolgus Monkeys with SEQ ID: 828 in Response to a Whey Protein Meal over 3 Consecutive Days (% Reduction Relative to Vehicle)

|  | Day 1 | Day 2 | Day 3 |
|---|---|---|---|
| Leucine (iAUC) | 24 | 27** | 19 |
| KIC (iAUC) | 41 | 51** | — |

**p < 0.01 (Unpaired t-test compared to Vehicle)

While the invention has been described with reference to the specific embodiments, various changes can be made and equivalents can be substituted to adapt to a particular situation, material, composition of matter, process, process step or steps, thereby achieving benefits of the invention without departing from the scope of what is claimed.

For all purposes, each and every publication and patent document cited in this disclosure is incorporated herein by reference as if each such publication or document was specifically and individually indicated to be incorporated herein by reference. Citation of publications and patent documents is not intended as an indication that any such document is pertinent prior art, nor does it constitute an admission as to its contents or date.

TABLE 1-2

Wild-Type Amino Acid Decarboxylases

| SEQ ID NO: (nt/aa) | Leucine Decarboxylase Source |
|---|---|
| 1/2 | Leucine Decarboxylase from *Streptomyces* sp. GP55 |
| 3/4 | Leucine Decarboxylase from *Saccharothrix* sp. ST-888 |
| 5/6 | Leucine Decarboxylase from *Kitasatospora* sp. MBT63 |
| 7/8 | Leucine Decarboxylase from *Kitasatospora* sp. MMS16-BH015 |
| 9/10 | Leucine Decarboxylase from *Streptomyces* sp. NRRL F-6131 |
| 11/12 | Leucine Decarboxylase from Planctomycetaceae bacterium |
| 13/14 | Amino Acid Decarboxylase from *Larkinella arboricola* |

TABLE 2.1

LDC Variants Based on SEQ ID NO: 12

| SEQ ID NO: (nt/aa) | Amino Acid Differences (Relative to SEQ ID NO: 12) |
|---|---|
| 15/16 | I34L/C38V/T39N/T127S/I245M/N350E/I357V |
| 17/18 | T39N/T102S/I264V/T275S/I357V |
| 19/20 | I34L/C38V/T39N/T102S/T275S/I357V |
| 21/22 | T39N/I245M/I264V/V267I/T275S/I357V |
| 23/24 | C38V/T39N/T127S/I264V/T275S |
| 25/26 | T39N/T127S/I245M/I357V |
| 27/28 | I34L/T39N/T275S/V349T/N350E/I357V |
| 29/30 | T39N/T127S/I245M/I264V/T275S/N350E/I357V |
| 31/32 | C38V/T39N/T102S/T127S/I264V/V267I/N350E/I357V |
| 33/34 | T39N/T275S/N350E/I357V |
| 35/36 | C38V/T39N/I245M/T275S/I357V |
| 37/38 | H14T/T39N/T102S/T127S/I245M/V267I/T275S/V349T/N350E |
| 39/40 | H14T/I34L/C38V/T39N/T102S/V267I/T275S/N350E/I357V |
| 41/42 | C38V/T39N/I264V/V267I/T275S/N350E |
| 43/44 | C38V/T39N/T127S/I264V/N350E/I357V |
| 45/46 | C38V/T39N/T102S/T127S/N350E |
| 47/48 | I34L/C38V/T39N/T102S/T127S/T275S/I357V |

TABLE 21

Average iAUC ± SEM for Plasma Analytes in Healthy Cynomolgus Monkeys with SEQ ID: 828 in Response to a Whey Protein Meal

|  | Day 1 | | Day 2 | | Day 3 | |
|---|---|---|---|---|---|---|
|  | Vehicle | Treatment | Vehicle | Treatment | Vehicle | Treatment |
| Leucine | 2376 ± 132 | 1803 ± 249 | 2065 ± 58 | 1517 ± 159 | 2756 ± 150 | 2236 ± 282 |
| KIC | 232 ± 41 | 137 ± 25 | 199 ± 20 | 97 ± 24 | 159 ± 44 | 173 ± 56 |
| Isoleucine | 1320 ± 79 | 1188 ± 171 | 1133 ± 36 | 1064 ± 105 | 1435 ± 75 | 1357 ± 157 |
| Valine | 2242 ± 196 | 2291 ± 252 | 1963 ± 82 | 1937 ± 148 | 2557 ± 228 | 2368 ± 261 |
| Methionine | 64 ± 11 | 82 ± 19 | 38 ± 5 | 45 ± 13 | 100 ± 23 | 101 ± 25 |
| Phenylalanine | 126 ± 31 | 150 ± 24 | 91 ± 18 | 133 ± 44 | 153 ± 30 | 130 ± 27 |

TABLE 2.1-continued

LDC Variants Based on SEQ ID NO: 12

| SEQ ID NO: (nt/aa) | Amino Acid Differences (Relative to SEQ ID NO: 12) |
|---|---|
| 49/50 | T39N/T102S/T127S/I264V/T275S/I357V |
| 51/52 | C38V/T39N/T127S/N350E/I357V |
| 53/54 | I34L/T39N/T102S/T127S/I264V/T275S/I357V |
| 55/56 | C38V/T39N/T275S/N350E |
| 57/58 | C38V/T39N/T127S/I245M/V267I/I357V |
| 59/60 | C38V/T39N/T102S/T127S/V267I/T275S/V349T/N350E/I357V |
| 61/62 | C38V/T39N/T275S |
| 63/64 | T39N/T127S/V267I/T275S/N350E/I357V |
| 65/66 | T39N/T127S/V267I/N350E/I357V |
| 67/68 | I34L/C38V/T39N/T127S/I245M/V349T/N350E/I357V |
| 69/70 | I34L/T39N/T102S/T127S/T275S/V349T/I357V |
| 71/72 | C38V/T39N/T127S/I357V |
| 73/74 | I34L/T39N/T102S/I264V/T275S/N350E/I357V |
| 75/76 | C38V/T39N/T102S/T127S/N350E/I357V |
| 77/78 | C38V/T39N/T102S/T127S/V349T/N350E/I357V |
| 79/80 | T39N/I264V/V267I/T275S/N350E |
| 81/82 | T39N/T127S/I357V |
| 83/84 | T39N/T127S/I245M/I264V/V267I/T275S/N350E |
| 85/86 | C38V/T39N/I264V/T275S/I357V |
| 87/88 | T39N/T102S/V267I/T275S/I357V |
| 89/90 | R395D |
| 91/92 | T397A |
| 93/94 | T39S |
| 95/96 | P398* |
| 97/98 | K389G |
| 99/100 | K389Q |
| 101/102 | L48F |
| 103/104 | T405L |
| 105/106 | A391* |
| 107/108 | H343E |
| 109/110 | K393T |
| 111/112 | K299A |
| 113/114 | H14I |
| 115/116 | K394E |
| 117/118 | A391E |
| 119/120 | K196R |
| 121/122 | H255G |
| 123/124 | K5M |
| 125/126 | K196D |
| 127/128 | R395K |
| 129/130 | H343A |
| 131/132 | R324M |
| 133/134 | R353E |
| 135/136 | L364R |
| 137/138 | K389E |
| 139/140 | N350S |
| 141/142 | I164C |
| 143/144 | R395A |
| 145/146 | H255P |
| 147/148 | I164A |
| 149/150 | K389P |
| 151/152 | K379D |
| 153/154 | H255N |
| 155/156 | Q365E |
| 157/158 | Q339D |
| 159/160 | T405H |
| 161/162 | A381D |
| 163/164 | I357C |
| 165/166 | T405E |
| 167/168 | T405D |
| 169/170 | R353W |
| 171/172 | R324T |
| 173/174 | A381E |
| 175/176 | N139G |
| 177/178 | K299V |
| 179/180 | K379P |
| 181/182 | Q339A |
| 183/184 | R324S |
| 185/186 | R353D |
| 187/188 | L364K |
| 189/190 | R395G |
| 191/192 | R353S |
| 193/194 | R395S |
| 195/196 | I357M |
| 197/198 | D386* |
| 199/200 | R353N |
| 201/202 | R353L |
| 203/204 | R318K |

APPENDIX

TABLE 3-2

LDC Variants Based on SEQ ID NO: 38

| SEQ ID NO: (nt/aa) | Amino Acid Differences (Relative to SEQ ID NO: 38) | Amino Acid Differences (Relative to SEQ ID NO: 12) |
|---|---|---|
| 205/206 | I164A/R324M/I357C/L364K | H14T/T39N/T102S/T127S/I164A/I245M/V267I/T275S/R324M/V349T/N350E/I357C/L364K |
| 207/208 | I164A/R353W/I357C/L364R | H14T/T39N/T102S/T127S/I164A/I245M/V267I/T275S/V349T/N350E/R353W/I357C/L364R |
| 209/210 | A64E/R318K/R324S/I357V/L364R | H14T/T39N/A64E/T102S/T127S/I245M/V267I/T275S/R318K/R324S/V349T/N350E/I357V/L364R |
| 211/212 | R318K/H343E/I357M | H14T/T39N/T102S/T127S/I245M/V267I/T275S/R318K/H343E/V349T/N350E/I357M |
| 213/214 | R324N/R353W/I357C/L364K | H14T/T39N/T102S/T127S/I245M/V267I/T275S/R324N/V349T/N350E/R353W/I357C/L364K |
| 215/216 | L48F/A64E/I357M/L364K | H14T/T39N/L48F/A64E/T102S/T127S/I245M/V267I/T275S/V349T/N350E/I357M/L364K |
| 217/218 | A64E/R324M/R353N/I357C/L364R | H14T/T39N/A64E/T102S/T127S/I245M/V267I/T275S/R324M/V349T/N350E/R353N/I357C/L364R |
| 219/220 | I164C/R353W/I357C/L364R | H14T/T39N/T102S/T127S/I164C/I245M/V267I/T275S/V349T/N350E/R353W/I357C/L364R |
| 221/222 | A64E/I164C/R353D/I357V | H14T/T39N/A64E/T102S/I164C/I164C/T127S/I245M/V267I/T275S/V349T/N350E/R353D/I357V |
| 223/224 | I164C/R324M/H343E/R353D/I357V/L364R | H14T/T39N/T102S/T127S/I164C/I245M/V267I/T275S/R324M/H343E/V349T/N350E/R353D/I357V/L364R |

TABLE 3-2-continued

LDC Variants Based on SEQ ID NO: 38

| SEQ ID NO: (nt/aa) | Amino Acid Differences (Relative to SEQ ID NO: 38) | Amino Acid Differences (Relative to SEQ ID NO: 12) |
|---|---|---|
| 225/226 | R318K/H343E/I357C | H14T/T39N/T102S/T127S/I245M/V267I/T275S/318K/H343E/V349T/N350E/I357C |
| 227/228 | I164A/L364R | H14T/T39N/T102S/T127S/I164A/I245M/V267I/T275S/V349T/N350E/L364R |
| 229/230 | L48F/A64E/I164A/R324M/H343E/L364R | H14T/T39N/L48F/A64E/T102S/T127S/I164A/I245M/V267I/T275S/R324M/H343E/V349T/N350E/L364R |
| 231/232 | I164C/R318K/R324S/I357V/L364R | H14T/T39N/L48F/A64E/T102S/T127S/I164A/I164A/I245M/V267I/T275S/R324M/H343E/V349T/N350E/L364R |
| 233/234 | I164A/R324M/H343E/R353D/I357C/L364R | H14T/T39N/T102S/T127S/I164A/I245M/V267I/T275S/R324M/H343E/V349T/N350E/R353D/I357C/L364R |
| 235/236 | L48F/A64E/I164A/R324M/H343E/R353E/I357C/L364K | H14T/T39N/L48F/A64E/T102S/T127S/I164A/I245M/V267I/T275S/R324M/H343E/V349T/N350E/R353E/I357C/L364K |
| 237/238 | R324M/I357M/L364R | H14T/T39N/T102S/T127S/I245M/V267I/T275S/R324M/V349T/N350E /I357M/L364R |
| 239/240 | I164A/R318K/R324M/H343E/R353E/I357C | H14T/T39N/T102S/T127S/I164A/I245M/V267I/T275S/R318K/R324M/H343E/V349T/N350E//R353E/I357C |
| 241/242 | I164C/R353D/I357V/L364R | H14T/T39N/T102S/T127S/I164C/I245M/V267I/T275S/V349T/N350E/R353D/I357V/L364R |
| 243/244 | A64E/I164A/R324M/H343E/R353D/I357V/L364K | H14T/T39N/A64E/T102S/T127S/I164A/I245M/V267I/T275S/R324M/H343E/V349T/N350E/R353D/I357V/L364K |
| 245/246 | L48F/A64E/I164C/R353N/I357V/L364R | H14T/T39N/L48F/A64E/T102S/T127S/I164C/I245M/V267I/T275S/V349T/N350E/R353N/I357V/L364R |
| 247/248 | R324M/H343E/I357V/L364K | H14T/T39N/T102S/T127S/I245M/V267I/T275S/R324M/H343E/V349T/N350E/I357V/L364K |
| 249/250 | I164C/R353D/I357V/L364K | H14T/T39N/T102S/T127S/I164C/I245M/V267I/T275S/V349T/N350E/R353D/I357V/L364K |
| 251/252 | I357V/L364R | H14T/T39N/T102S/T127S/I245M/V267I/T275S/V349T/N350E/I357V/L364R |
| 253/254 | I164A/K196D/R324M/I357C/L364K | H14T/T39N/T102S/T127S/I245M/I164A/K196D/V267I/T275S/R324M/V349T/N350E/I357C/L364K |
| 255/256 | K196D/R318K/R324M/R353N/I357C/L364K | H14T/T39N/T102S/T127S/K196D/I245M/V267I/T275S/R318K/R324M/V349T/N350E/R353N/I357C/L364K |
| 257/258 | A64E/I164A/R324M/H343E/I357C/L364R | H14T/T39N/A64E/T102S/T127S/I164A/I245M/V267I/T275S/R324M/H343E/R324M/H343E/V349T/N350E/I357C/L364R |
| 259/260 | K389G/K394E/R395D/T397A/T405D | H14T/T39N/T102S/T127S/I245M/V267I/T275S/V349T/N350E/K389G/K394E/R395D/T397A/T405D |
| 261/262 | Y132F/H255P/Q339A/K379D/R395D | H14T/T39N/T102S/T127S/Y132F/I245M/V267I/H255P/T275S/Q339A/V349T/N350E/K379D/R395D |
| 263/264 | K379D/D386* | H14T/T39N/T102S/T127S/I245M/V267I/T275S/V349T/N350E/K379D/D386* |
| 265/266 | Q339A/A391* | H14T/T39N/T102S/T127S/I245M/V267I/T275S/Q339A/V349T/N350E/A391* |
| 267/268 | Q339A/K389G/R395K | H14T/T39N/T102S/T127S/I245M/V267I/T275S/Q339A/V349T/N350E/K389G/R395K |
| 269/270 | K379D/K394E/R395D/T397A/R404I/T405H | H14T/T39N/T102S/T127S/I245M/V267I/T275S/V349T/N350E/K379D/K394E/R395D/T397A/R404I/T405H |
| 271/272 | K379D/K394E/R395K/T397A/T405D | H14T/T39N/T102S/T127S/I245M/V267I/T275S/V349T/N350E/K379D/K394E/R395K/T397A/T405D |
| 273/274 | Q339A/K394E/R395K/T405D | H14T/T39N/T102S/T127S/I245M/V267I/T275S/Q339A/V349T/N350E/K394E/R395K/T405D |
| 275/276 | K394E/T397A | H14T/T39N/T102S/T127S/I245M/V267I/T275S/V349T/N350E/K394E/T397A |
| 277/278 | Q339A/K379D/K389G/K394E/R395D | H14T/T39N/T102S/T127S/I245M/V267I/T275S/Q339A/V349T/N350E/K379D/K389G/K394E/R395D |

TABLE 4-1

LDC Variants Based on SEQ ID NO: 234

| SEQ ID NO: (nt/aa) | Amino Acid Differences (Relative to SEQ ID NO: 234) | Amino Acid Differences (Relative to SEQ ID NO: 12) |
|---|---|---|
| 279/280 | R318K/Q339A/K379D | H14T/T39N/T102S/T127S/I164A/I245M/V267I/T275S/R324M/R318K/Q339A/H343E/V349T/N350E/R353D/I357C/L364R/K379D |
| 281/282 | A64E/H255P | H14T/T39N/A64E/T102S/T127S/I164A/I245M/H255P/V267I/T275S/R324M/H343E/V349T/N350E/R353D/I357C/L364R |

TABLE 4-1-continued

LDC Variants Based on SEQ ID NO: 234

| SEQ ID NO: (nt/aa) | Amino Acid Differences (Relative to SEQ ID NO: 234) | Amino Acid Differences (Relative to SEQ ID NO: 12) |
|---|---|---|
| 283/284 | L48F/A64E/H255P | H14T/T39N/L48F/A64E/T102S/T127S/I164A/I245M/ H255P/V267I/T275S/R324M/H343E/V349T/N350E/R353D/ I357C/L364R |
| 285/286 | H255P | H14T/T39N/T102S/T127S/I164A/I245M/H255P/V267I/ T275S/R324M/H343E/V349T/N350E/R353D/I357C/L364R |
| 287/288 | T405H | H14T/T39N/T102S/T127S/I164A/I245M/V267I/T275S/ R324M/H343E/V349T/N350E/R353D/I357C/L364R/T405H |
| 289/290 | H255P/R318K/K379D | H14T/T39N/T102S/T127S/I164A/I245M/H255P/V267I/ T275S/R318K/R324M/H343E/V349T/N350E/R353D/I357C/ L364R/K379D |
| 291/292 | L48F/H255P/K379D | H14T/T39N/L48F/T102S/T127S/I164A/I245M/H255P/ V267I/T275S/R324M/H343E/V349T/N350E/R353D/I357C/ L364R/K379D |
| 293/294 | A64E | H14T/T39N/A64E/T102S/T127S/I164A/I245M/V267I/ T275S/R324M/H343E/V349T/N350E/R353D/I357C/L364R |
| 295/296 | Q339A | H14T/T39N/T102S/T127S/I164A/I245M/V267I/T275S/ R324M/Q339A/H343E/V349T/N350E/R353D/I357C/L364R |
| 297/298 | L48F/H255P/Q339A | H14T/T39N/L48F/T102S/T127S/I164A/I245M/H255P/ V267I/T275S/R324M/Q339A/H343E/V349T/N350E/R353D/ I357C/L364R |
| 299/300 | G2E | G2E/H14T/T39N/T102S/T127S/I164A/I245M/V267I/ T275S/R324M/H343E/V349T/N350E/R353D/I357C/L364R |
| 301/302 | A380E | H14T/T39N/T102S/T127S/I164A/I245M/V267I/T275S/ R324M/H343E/V349T/N350E/R353D/I357C/L364R/A380E |
| 303/304 | S340V | H14T/T39N/T102S/T127S/I164A/I245M/V267I/T275S/ R324M/S340V/H343E/V349T/N350E/R353D/I357C/L364R |
| 305/306 | A382S | H14T/T39N/T102S/T127S/I164A/I245M/V267I/T275S/ R324M/H343E/V349T/N350E/R353D/I357C/L364R/A382S |
| 307/308 | P390A | H14T/T39N/T102S/T127S/I164A/I245M/V267I/T275S/ R324M/H343E/V349T/N350E/R353D/I357C/L364R/P390A |
| 309/310 | T161V | H14T/T39N/T102S/T127S/T161V/I164A/I245M/V267I/ T275S/R324M/H343E/V349T/N350E/R353D/I357C/L364R |
| 311/312 | A64S | H14T/T39N/A64S/T102S/T127S/I164A/I245M/V267I/ T275S/R324M/H343E/V349T/N350E/R353D/I357C/L364R |
| 313/314 | M193I | H14T/T39N/T102S/T127S/I164A/M193I/I245M/V267I/ T275S/R324M/H343E/V349T/N350E/R353D/I357C/L364R |
| 315/316 | V69I | H14T/T39N/V69I/T102S/T127S/I164A/I245M/V267I/ T275S/R324M/H343E/V349T/N350E/R353D/I357C/L364R |
| 317/318 | S340T | H14T/T39N/T102S/T127S/I164A/I245M/V267I/T275S/ R324M/S340T/H343E/V349T/N350E/R353D/I357C/L364R |
| 319/320 | S263V | H14T/T39N/T102S/T127S/I164A/I245M/S263V/V267I/ T275S/R324M/H343E/V349T/N350E/R353D/I357C/L364R |
| 321/322 | P390E | H14T/T39N/T102S/T127S/I164A/I245M/V267I/T275S/ R324M/H343E/V349T/N350E/R353D/I357C/L364R/P390E |
| 323/324 | N3M | N3M/H14T/T39N/T102S/T127S/I164A/I245M/V267I/ T275S/R324M/H343E/V349T/N350E/R353D/I357C/L364R |
| 325/326 | P390* | H14T/T39N/T102S/T127S/I164A/I245M/V267I/T275S/ R324M/H343E/V349T/N350E/R353D/I357C/L364R/P390* |
| 327/328 | P390S | H14T/T39N/T102S/T127S/I164A/I245M/V267I/T275S/ R324M/H343E/V349T/N350E/R353D/I357C/L364R/P390S |
| 329/330 | A401* | H14T/T39N/T102S/T127S/I164A/I245M/V267I/T275S/ R324M/H343E/V349T/N350E/R353D/I357C/L364R/A401* |
| 331/332 | S263T | H14T/T39N/T102S/T127S/I164A/I245M/S263T/V267I/ T275S/R324M/H343E/V349T/N350E/R353D/I357C/L364R |
| 333/334 | A401Y | H14T/T39N/T102S/T127S/I164A/I245M/V267I/T275S/ R324M/H343E/V349T/N350E/R353D/I357C/L364R/A401Y |
| 335/336 | F33L | H14T/F33L/T39N/T102S/T127S/I164A/I245M/V267I/ T275S/R324M/H343E/V349T/N350E/R353D/I357C/L364R |
| 337/338 | R259L | H14T/T39N/T102S/T127S/I164A/I245M/R259L/V267I/ T275S/R324M/H343E/V349T/N350E/R353D/I357C/L364R |
| 339/340 | R395D/T397A | H14T/T39N/T102S/T127S/I164A/I245M/V267I/T275S/ R324M/H343E/V349T/N350E/R353D/I357C/L364R/R395D/ T397A |
| 341/342 | K394E | H14T/T39N/T102S/T127S/I164A/I245M/V267I/T275S/ R324M/H343E/V349T/N350E/R353D/I357C/L364R/K394E |
| 343/344 | T397A | H14T/T39N/T102S/T127S/I164A/I245M/V267I/T275S/ R324M/H343E/V349T/N350E/R353D/I357C/L364R/T397A |
| 345/346 | R395K | H14T/T39N/T102S/T127S/I164A/I245M/V267I/T275S/ R324M/H343E/V349T/N350E/R353D/I357C/L364R/R395K |
| 347/348 | M324N/K394E/R395K/T397A | H14T/T39N/T102S/T127S/I164A/I245M/V267I/T275S/ R324N/H343E/V349T/N350E/R353D/I357C/L364R/K394E/ R395K/T397A |

TABLE 4-1-continued

LDC Variants Based on SEQ ID NO: 234

| SEQ ID NO: (nt/aa) | Amino Acid Differences (Relative to SEQ ID NO: 234) | Amino Acid Differences (Relative to SEQ ID NO: 12) |
|---|---|---|
| 349/350 | K389G | H14T/T39N/T102S/T127S/I164A/I245M/V267I/T275S/R324M/H343E/V349T/N350E/R353D/I357C/L364R/K389G |
| 351/352 | K389G/K394E/R395D | H14T/T39N/T102S/T127S/I164A/I245M/V267I/T275S/R324M/H343E/V349T/N350E/R353D/I357C/L364R/K389G/K394E/R395D |
| 353/354 | K389G/K394E/R395D/T397A | H14T/T39N/T102S/T127S/I164A/I245M/V267I/T275S/R324M/H343E/V349T/N350E/R353D/I357C/L364R/K389G/K394E/R395D/T397A |
| 355/356 | M324S/K394E/R395K | H14T/T39N/T102S/T127S/I164A/I245M/V267I/T275S/R324S/H343E/V349T/N350E/R353D/I357C/L364R/K394E/R395K |
| 357/358 | M324S/K389G/K394E/R395D | H14T/T39N/T102S/T127S/I164A/I245M/V267I/T275S/R324S/H343E/V349T/N350E/R353D/I357C/L364R/K389G/K394E/R395D |
| 359/360 | K394E/R395D | H14T/T39N/T102S/T127S/I164A/I245M/V267I/T275S/R324M/H343E/V349T/N350E/R353D/I357C/L364R/K394E/R395D |
| 361/362 | M324S/K394E | H14T/T39N/T102S/T127S/I164A/I245M/V267I/T275S/R324S/H343E/V349T/N350E/R353D/I357C/L364R/K394E |
| 363/364 | M324N/R395D | H14T/T39N/T102S/T127S/I164A/I245M/V267I/T275S/R324N/H343E/V349T/N350E/R353D/I357C/L364R/R395D |
| 365/366 | K389G/K394E | H14T/T39N/T102S/T127S/I164A/I245M/V267I/T275S/R324M/H343E/V349T/N350E/R353D/I357C/L364R/K389G/K394E |
| 367/368 | K389G/R395D | H14T/T39N/T102S/T127S/I164A/I245M/V267I/T275S/R324M/H343E/V349T/N350E/R353D/I357C/L364R/K389G/R395D |
| 369/370 | M324S/R395K | H14T/T39N/T102S/T127S/I164A/I245M/V267I/T275S/R324S/H343E/V349T/N350E/R353D/I357C/L364R/R395K |
| 371/372 | M324S/K394E/R395K/T397A | H14T/T39N/T102S/T127S/I164A/I245M/V267I/T275S/R324S/H343E/V349T/N350E/R353D/I357C/L364R/K394E/R395K/T397A |
| 373/374 | K389G/K394E/R395K/T397A | H14T/T39N/T102S/T127S/I164A/I245M/V267I/T275S/R324M/H343E/V349T/N350E/R353D/I357C/L364R/K389G/K394E/R395K/T397A |
| 375/376 | M324S/K389G/K394E | H14T/T39N/T102S/T127S/I164A/I245M/V267I/T275S/R324S/H343E/V349T/N350E/R353D/I357C/L364R/K389G/K394E |
| 377/378 | K389G/R395K | H14T/T39N/T102S/T127S/I164A/I245M/V267I/T275S/R324M/H343E/V349T/N350E/R353D/I357C/L364R/K389G/R395K |
| 379/380 | K389G/T397A | H14T/T39N/T102S/T127S/I164A/I245M/V267I/T275S/R324M/H343E/V349T/N350E/R353D/I357C/L364R/K389G/T397A |
| 381/382 | K389G/K394E/R395K | H14T/T39N/T102S/T127S/I164A/I245M/V267I/T275S/R324M/H343E/V349T/N350E/R353D/I357C/L364R/K389G/K394E/R395K |
| 383/384 | M324N | H14T/T39N/T102S/T127S/I164A/I245M/V267I/T275S/R324N/H343E/V349T/N350E/R353D/I357C/L364R |
| 385/386 | K389G/K394E/T397A | H14T/T39N/T102S/T127S/I164A/I245M/V267I/T275S/R324M/H343E/V349T/N350E/R353D/I357C/L364R/K389G/K394E/T397A |
| 387/388 | M324S/K389G/K394E/T397A | H14T/T39N/T102S/T127S/I164A/I245M/V267I/T275S/R324S/H343E/V349T/N350E/R353D/I357C/L364R/K389G/K394E/T397A |
| 389/390 | K394E/R395K/T397A | H14T/T39N/T102S/T127S/I164A/I245M/V267I/T275S/R324M/H343E/V349T/N350E/R353D/I357C/L364R/K394E/R395K/T397A |

TABLE 5-1

LDC Variants Based on SEQ ID NO: 284

| SEQ ID NO: (nt/aa) | Amino Acid Differences (Relative to SEQ ID NO: 284) | Amino Acid Differences (Relative to SEQ ID NO: 12) |
|---|---|---|
| 391/392 | E64S/V69I/M324S/Q339A/A380E/K389G/P390* | H14T/T39N/L48F/A64S/V69I/T102S/T127S/I164A/I245M/H255P/V267I/T275S/R324S/Q339A/H343E/V349T/N350E/R353D/I357C/L364R/A380E/K389G/P390* |
| 393/394 | V69I/S263T/K389G/P390* | H14T/T39N/L48F/A64E/V69I/T102S/T127S/I164A/I245M/H255P/S263T/S263T/V267I/T275S/R324M/H343E/V349T/N350E/R353D/I357C/L364R/K389G/P390* |

TABLE 5-1-continued

LDC Variants Based on SEQ ID NO: 284

| SEQ ID NO: (nt/aa) | Amino Acid Differences (Relative to SEQ ID NO: 284) | Amino Acid Differences (Relative to SEQ ID NO: 12) |
|---|---|---|
| 395/396 | E64S/V69I/Q339A/K389G/P390* | H14T/T39N/L48F/A64S/V69I/T102S/T127S/I164A/I245M/H255P/V267I/T275S/R324M/Q339A/H343E/V349T/N350E/R353D/I357C/L364R/K389G/P390* |
| 397/398 | N3M/E64S/V69I/S263T/Q339A/A380E/Q388A | N3M/H14T/T39N/L48F/A64S/V69I/T102S/T127S/I164A/I245M/H255P/S263T/V267I/T275S/R324M/Q339A/H343E/V349T/N350E/R353D/I357C/L364R/A380E/Q388A |
| 399/400 | N3M/V69I/M324S/A380E/A382S/K389G/P390* | N3M/H14T/T39N/L48F/A64E/V69I/T102S/T127S/I164A/I245M/H255P/V267I/T275S/R324S/H343E/V349T/N350E/R353D/I357C/L364R/A380E/A382S/K389G/P390* |
| 401/402 | V69I/Q339A/P390* | H14T/T39N/L48F/A64E/V69I/T102S/T127S/I164A/I245M/H255P/V267I/T275S/R324M/Q339A/H343E/V349T/N350E/R353D/I357C/L364R/P390* |
| 403/404 | S263T/P390* | H14T/T39N/L48F/A64E/T102S/T127S/I164A/I245M/H255P/S263T/V267I/T275S/R324M/H343E/V349T/N350E/R353D/I357C/L364R/P390* |
| 405/406 | E64S/V69I/K389G | H14T/T39N/L48F/A64S/V69I/T102S/T127S/I164A/I245M/H255P/V267I/T275S/R324M/H343E/V349T/N350E/R353D/I357C/L364R/K389G |
| 407/408 | V69I/S263T | H14T/T39N/L48F/A64E/V69I/T102S/T127S/I164A/I245M/H255P/S263T/V267I/T275S/R324M/H343E/V349T/N350E/R353D/I357C/L364R |
| 409/410 | F48L/E64A/P255H | H14T/T39N/T102S/T127S/I164A/I245M/V267I/T275S/R324M/H343E/V349T/N350E/R353D/I357C/L364R |
| 411/412 | V69I/A223M/S263T/M324S/A382S/Q388A/P390* | H14T/T39N/L48F/A64E/V69I/T102S/T127S/I164A/A223M/I245M/H255P/S263T/V267I/T275S/R324S/H343E/V349T/N350E/R353D/I357C/L364R/A382S/Q388A/P390* |
| 413/414 | V69I/M324S/K379D/A380E/Q388A | H14T/T39N/L48F/A64E/V69I/T102S/T127S/I164A/I245M/H255P/V267I/T275S/R324S/H343E/V349T/N350E/R353D/I357C/L364R/K379D/A380E/Q388A |
| 415/416 | E64S/V69I/T189A/R259Q/S263T/A304R/Q339A/S340T/K379N | H14T/T39N/L48F/A64S/V69I/T102S/T127S/I164A/T189A/I245M/H255P/R259Q/S263T/V267I/T275S/A304R/R324M/Q339A/S340T/H343E/V349T/N350E/R353D/I357C/L364R/K379N |
| 417/418 | V69I/S263T/Q339A | H14T/T39N/L48F/A64E/V69I/T102S/T127S/I164A/I245M/H255P/S263T/V267I/T275S/R324M/Q339A/H343E/V349T/N350E/R353D/I357C/L364R |
| 419/420 | N3M/E64S/K379D/A380E/P390* | N3M/H14T/T39N/L48F/A64S/T102S/T127S/I164A/I245M/H255P/V267I/T275S/R324M/H343E/V349T/N350E/R353D/I357C/L364R/K379D/A380E/P390* |
| 421/422 | E64S/V69I/T189D/R259K/S263T/A304R | H14T/T39N/L48F/A64S/V69I/T102S/T127S/I164A/T189D/I245M/H255P/R259K/S263T/V267I/T275S/A304R/R324M/H343E/V349T/N350E/R353D/I357C/L364R |
| 423/424 | N3M/E64S/V69I/K389G | N3M/H14T/T39N/L48F/A64S/V69I/T102S/T127S/I164A/I245M/H255P/V267I/T275S/R324M/H343E/V349T/N350E/R353D/I357C/L364R/K389G |
| 425/426 | E64S/V69I/A223M/Q388A | H14T/T39N/L48F/A64S/V69I/T102S/T127S/I164A/A223M/I245M/H255P/V267I/T275S/R324M/H343E/V349T/N350E/R353D/I357C/L364R/Q388A |
| 427/428 | S263T/Q339A/K389G/P390* | H14T/T39N/L48F/A64E/T102S/T127S/I164A/I245M/H255P/S263T/V267I/T275S/R324M/Q339A/H343E/V349T/N350E/R353D/I357C/L364R/K389G/P390* |
| 429/430 | V69I/S263T/Q388A | H14T/T39N/L48F/A64E/V69I/T102S/T127S/I164A/I245M/H255P/S263T/V267I/T275S/R324M/H343E/V349T/N350E/R353D/I357C/L364R/Q388A |
| 431/432 | G2E/E64S/V69I/M324S/A380E/A382S/Q388A/K389G | G2E/H14T/T39N/L48F/A64S/V69I/T102S/T127S/I164A/I245M/H255P/V267I/T275S/R324S/H343E/V349T/N350E/R353D/I357C/L364R/A380E/A382S/Q388A/K389G |
| 433/434 | E64S/M324S/Q339A/K389G/P390* | H14T/T39N/L48F/A64S/T102S/T127S/I164A/I245M/H255P/V267I/T275S/R324S/Q339A/H343E/V349T/N350E/R353D/I357C/L364R/K389G/P390* |
| 435/436 | V69I/A223M/M324S/K379D/A380E/A382S/Q388A/P390* | H14T/T39N/L48F/A64E/V69I/T102S/T127S/I164A/A223M/I245M/H255P/V267I/T275S/R324S/H343E/V349T/N350E/R353D/I357C/L364R/K379D/A380E/A382S/Q388A/P390* |
| 437/438 | E64S/V69I/Q339A/A382S/Q388A/K389G | H14T/T39N/L48F/A64S/V69I/T102S/T127S/I164A/I245M/H255P/V267I/T275S/R324M/Q339A/H343E/V349T/N350E/R353D/I357C/L364R/A382S/Q388A/K389G |
| 439/440 | N3M/E64S/V69I/P390* | N3M/H14T/T39N/L48F/A64S/V69I/T102S/T127S/I164A/I245M/H255P/V267I/T275S/R324M/H343E/V349T/N350E/R353D/I357C/L364R/P390* |
| 441/442 | E64S/V69I/P390* | H14T/T39N/L48F/A64S/V69I/T102S/T127S/I164A/I245M/H255P/V267I/T275S/R324M/H343E/V349T/N350E/R353D/I357C/L364R/P390* |
| 443/444 | N3M/V69I/M324S | N3M/H14T/T39N/L48F/A64E/V69I/T102S/T127S/I164A/I245M/H255P/V267I/T275S/R324S/H343E/V349T/N350E/R353D/I357C/L364R |

TABLE 5-1-continued

LDC Variants Based on SEQ ID NO: 284

| SEQ ID NO: (nt/aa) | Amino Acid Differences (Relative to SEQ ID NO: 284) | Amino Acid Differences (Relative to SEQ ID NO: 12) |
|---|---|---|
| 447/448 | E64S/V69I/A223M/Q388A/ K389G/P390* | H14T/T39N/L48F/A64S/V69I/T102S/T127S/I164A/A223M/ I245M/H255P/V267I/T275S/R324M/H343E/V349T/N350E/ R353D/I357C/L364R/Q388A/K389G/P390* |
| 449/450 | E64S/S263T | H14T/T39N/L48F/A64S/T102S/T127S/I164A/I245M/H255P/ S263T/V267I/T275S/R324M/H343E/V349T/N350E/R353D/ I357C/L364R |
| 451/452 | E64A/P255H/S263T | H14T/T39N/L48F/T102S/T127S/I164A/I245M/S263T/V267I/ T275S/R324M/H343E/V349T/N350E/R353D/I357C/L364R |
| 453/454 | V69I/A382S/P390* | H14T/T39N/L48F/A64E/V69I/T102S/T127S/I164A/I245M/ H255P/V267I/T275S/R324M/H343E/V349T/N350E/R353D/ I357C/L364R/A382S/P390* |
| 455/456 | V69I/M324S/A380E | H14T/T39N/L48F/A64E/V69I/T102S/T127S/I164A/I245M/ H255P/V267I/T275S/R324S/H343E/V349T/N350E/R353D/ I357C/L364R/A380E |
| 457/458 | V69I/S263T/M324S | H14T/T39N/L48F/A64E/V69I/T102S/T127S/I164A/I245M/ H255P/S263T/V267I/T275S/R324S/H343E/V349T/N350E/ R353D/I357C/L364R |
| 459/460 | E64S/V69I | H14T/T39N/L48F/A64S/V69I/T102S/T127S/I164A/I245M/ H255P/V267I/T275S/R324M/H343E/V349T/N350E/R353D/ I357C/L364R |
| 461/462 | E64S/V69I/Q339A | H14T/T39N/L48F/A64S/V69I/T102S/T127S/I164A/I245M/ H255P/V267I/T275S/R324M/Q339A/H343E/V349T/N350E/ R353D/I357C/L364R |
| 463/464 | E64S/V69I/M324S | H14T/T39N/L48F/A64S/V69I/T102S/T127S/I164A/I245M/ H255P/V267I/T275S/R324S/H343E/V349T/N350E/R353D/ I357C/L364R |
| 465/466 | N3M/V69I/S263T/A380E | N3M/H14T/T39N/L48F/A64E/V69I/T102S/T127S/I164A/ I245M/H255P/S263T/V267I/T275S/R324M/H343E/V349T/ N350E/R353D/I357C/L364R/A380E |
| 467/468 | R259K/S263T/A304R/ Q339A/S340T/K379N | H14T/T39N/L48F/A64E/T102S/T127S/I164A/I245M/H255P/ R259K/S263T/V267I/T275S/A304R/R324M/Q339A/S340T/ H343E/V349T/N350E/R353D/I357C/L364R/K379N |
| 469/470 | R259K/S263T/A304R | H14T/T39N/L48F/A64E/T102S/T127S/I164A/I245M/H255P/ R259K/S263T/V267I/T275S/A304R/R324M/H343E/V349T/ N350E/R353D/I357C/L364R |
| 471/472 | S12G/R259K/S263T/A304R | S12G/H14T/T39N/L48F/A64E/T102S/T127S/I164A/I245M/ H255P/R259K/S263T/V267I/T275S/A304R/R324M/H343E/ V349T/N350E/R353D/I357C/L364R |
| 473/474 | E64S/V69I/K379D/A380E | H14T/T39N/L48F/A64S/V69I/T102S/T127S/I164A/I245M/ H255P/V267I/T275S/R324M/H343E/V349T/N350E/R353D/ I357C/L364R/K379D/A380E |
| 475/476 | S12G/L135V/R259K/S263T | S12G/H14T/T39N/L48F/A64E/T102S/T127S/L135V/I164A/ I245M/H255P/R259K/S263T/V267I/T275S/R324M/H343E/ V349T/N350E/R353D/I357C/L364R |
| 477/478 | E64S/V69I/A304R/K379E/ A382G | H14T/T39N/L48F/A64S/V69I/T102S/T127S/I164A/I245M/ H255P/V267I/T275S/A304R/R324M/H343E/V349T/N350E/ R353D/I357C/L364R/K379E/A382G |
| 479/480 | A304R/S340T/K379D/A380E/ A382G | H14T/T39N/L48F/A64E/T102S/T127S/I164A/I245M/H255P/ V267I/T275S/A304R/R324M/S340T/H343E/V349T/N350E/ R353D/I357C/L364R/K379D/A380E/A382G |
| 481/482 | S12G/L135V/S263T/A382G | S12G/H14T/T39N/L48F/A64E/T102S/T127S/L135V/I164A/ I245M/H255P/S263T/V267I/T275S/R324M/H343E/V349T/ N350E/R353D/I357C/L364R/A382G |
| 483/484 | E64S/V69I/A380E/Q388A/ P390* | H14T/T39N/L48F/A64S/V69I/T102S/T127S/I164A/I245M/ H255P/V267I/T275S/R324M/H343E/V349T/N350E/R353D/ I357C/L364R/A380E/Q388A/P390* |

TABLE 6-1

LDC Variants Based on SEQ ID NO: 484

| SEQ ID NO: (nt/aa) | Amino Acid Differences (Relative to SEQ ID NO: 484) | Amino Acid Differences (Relative to SEQ ID NO: 12) |
|---|---|---|
| 485/486 | R259K/A304R | H14T/T39N/L48F/A64S/V69I/T102S/T127S/I164A/I245M/ H255P/R259K/V267I/T275S/A304R/R324M/H343E/V349T/ N350E/R353D/I357C/L364R/A380E/Q388A/P390* |
| 487/488 | R259K/S263T/A304R | H14T/T39N/L48F/A64S/V69I/T102S/T127S/I164A/I245M/ H255P/R259K/S263T/V267I/T275S/A304R/R324M/H343E/ V349T/N350E/R353D/I357C/L364R/A380E/Q388A/P390* |

TABLE 6-1-continued

LDC Variants Based on SEQ ID NO: 484

| SEQ ID NO: (nt/aa) | Amino Acid Differences (Relative to SEQ ID NO: 484) | Amino Acid Differences (Relative to SEQ ID NO: 12) |
|---|---|---|
| 489/490 | R259K/S263T/A304R/M324S | H14T/T39N/L48F/A64S/V69I/T102S/T127S/I164A/I245M/H255P/R259K/S263T/V267I/T275S/A304R/R324S/H343E/V349T/N350E/R353D/I357C/L364R/A380E/Q388A/P390* |
| 491/492 | N3M/R259K/A304R/M324S/Q339A | N3M/H14T/T39N/L48F/A64S/V69I/T102S/T127S/I164A/I245M/H255P/R259K/V267I/T275S/A304R/R324S/Q339A/H343E/V349T/N350E/R353D/I357C/L364R/A380E/Q388A/P390* |
| 493/494 | A304R/M324S | H14T/T39N/L48F/A64S/V69I/T102S/T127S/I164A/I245M/H255P/V267I/T275S/A304R/R324S/H343E/V349T/N350E/R353D/I357C/L364R/A380E/Q388A/P390* |
| 495/496 | S263T/A304R/M324S | H14T/T39N/L48F/A64S/V69I/T102S/T127S/I164A/I245M/H255P/S263T/V267I/T275S/A304R/R324S/H343E/V349T/N350E/R353D/I357C/L364R/A380E/Q388A/P390* |
| 497/498 | N3M/S263T/A304R/M324S/A382S | N3M/H14T/T39N/L48F/A64S/V69I/T102S/T127S/I164A/I245M/H255P/S263T/V267I/T275S/A304R/R324S/H343E/V349T/N350E/R353D/I357C/L364R/A380E/A382S/Q388A/P390* |
| 499/500 | S263T/A304R/M324S/A382S | H14T/T39N/L48F/A64S/V69I/T102S/T127S/I164A/I245M/H255P/S263T/V267I/T275S/A304R/R324S/H343E/V349T/N350E/R353D/I357C/L364R/A380E/A382S/Q388A/P390* |
| 501/502 | M324S | H14T/T39N/L48F/A64S/V69I/T102S/T127S/I164A/I245M/H255P/V267I/T275S/R324S/H343E/V349T/N350E/R353D/I357C/L364R/A380E/Q388A/P390* |
| 503/504 | A382S | H14T/T39N/L48F/A64S/V69I/T102S/T127S/I164A/I245M/H255P/V267I/T275S/R324M/H343E/V349T/N350E/R353D/I357C/L364R/A380E/A382S/Q388A/P390* |
| 505/506 | R259K/A304R/M324S/Q339A | H14T/T39N/L48F/A64S/V69I/T102S/T127S/I164A/I245M/H255P/R259K/V267I/T275S/A304R/R324S/Q339A/H343E/V349T/N350E/R353D/I357C/L364R/A380E/Q388A/P390* |
| 507/508 | S263T/M324S | H14T/T39N/L48F/A64S/V69I/T102S/T127S/I164A/I245M/H255P/S263T/V267I/T275S/R324S/H343E/V349T/N350E/R353D/I357C/L364R/A380E/Q388A/P390* |
| 509/510 | R259K/A304R/M324S | H14T/T39N/L48F/A64S/V69I/T102S/T127S/I164A/I245M/H255P/R259K/V267I/T275S/A304R/R324S/H343E/V349T/N350E/R353D/I357C/L364R/A380E/Q388A/P390* |
| 511/512 | N3M/R259K/A304R | N3M/H14T/T39N/L48F/A64S/V69I/T102S/T127S/I164A/I245M/H255P/R259K/V267I/T275S/A304R/R324M/H343E/V349T/N350E/R353D/I357C/L364R/A380E/Q388A/P390* |
| 513/514 | R259K/S263T/A304R/A382S | H14T/T39N/L48F/A64S/V69I/T102S/T127S/I164A/I245M/H255P/R259K/S263T/V267I/T275S/A304R/R324M/H343E/V349T/N350E/R353D/I357C/L364R/A380E/A382S/Q388A/P390* |
| 515/516 | N3M/S263T/A304R/M324S | N3M/H14T/T39N/L48F/A64S/V69I/T102S/T127S/I164A/I245M/H255P/S263T/V267I/T275S/A304R/R324S/H343E/V349T/N350E/R353D/I357C/L364R/A380E/Q388A/P390* |
| 517/518 | R259K | H14T/T39N/L48F/A64S/V69I/T102S/T127S/I164A/I245M/H255P/R259K/V267I/T275S/R324M/H343E/V349T/N350E/R353D/I357C/L364R/A380E/Q388A/P390* |
| 519/520 | N3M/A304R/M324S | N3M/H14T/T39N/L48F/A64S/V69I/T102S/T127S/I164A/I245M/H255P/V267I/T275S/A304R/R324S/H343E/V349T/N350E/R353D/I357C/L364R/A380E/Q388A/P390* |
| 521/522 | N3M/R259K/S263T/A304R | N3M/H14T/T39N/L48F/A64S/V69I/T102S/T127S/I164A/I245M/H255P/R259K/S263T/V267I/T275S/A304R/R324M/H343E/V349T/N350E/R353D/I357C/L364R/A380E/Q388A/P390* |
| 523/524 | S263T/A304R/M324S/Q339A | H14T/T39N/L48F/A64S/V69I/T102S/T127S/I164A/I245M/H255P/S263T/V267I/T275S/A304R/R324S/Q339A/H343E/V349T/N350E/R353D/I357C/L364R/A380E/Q388A/P390* |
| 525/526 | R259K/S263T/A304R/M324S/A382S | H14T/T39N/L48F/A64S/V69I/T102S/T127S/I164A/I245M/H255P/R259K/S263T/V267I/T275S/A304R/R324S/H343E/V349T/N350E/R353D/I357C/L364R/A380E/A382S/Q388A/P390* |
| 527/528 | N3M/R259K/A304R/M324S/A382S | N3M/H14T/T39N/L48F/A64S/V69I/T102S/T127S/I164A/I245M/H255P/R259K/V267I/T275S/A304R/R324S/H343E/V349T/N350E/R353D/I357C/L364R/A380E/A382S/Q388A/P390* |
| 529/530 | S263T/A304R | H14T/T39N/L48F/A64S/V69I/T102S/T127S/I164A/I245M/H255P/S263T/V267I/T275S/A304R/R324M/H343E/V349T/N350E/R353D/I357C/L364R/A380E/Q388A/P390* |
| 531/532 | N3M/A304R | N3M/H14T/T39N/L48F/A64S/V69I/T102S/T127S/I164A/I245M/H255P/V267I/T275S/A304R/R324M/H343E/V349T/N350E/R353D/I357C/L364R/A380E/Q388A/P390* |
| 533/534 | A304R | H14T/T39N/L48F/A64S/V69I/T102S/T127S/I164A/I245M/H255P/V267I/T275S/A304R/R324M/H343E/V349T/N350E/R353D/I357C/L364R/A380E/Q388A/P390* |

TABLE 6-1-continued

LDC Variants Based on SEQ ID NO: 484

| SEQ ID NO: (nt/aa) | Amino Acid Differences (Relative to SEQ ID NO: 484) | Amino Acid Differences (Relative to SEQ ID NO: 12) |
|---|---|---|
| 535/536 | R259K/S263T/A304R/K379D | H14T/T39N/L48F/A64S/V69I/T102S/T127S/I164A/I245M/H255P/R259K/S263T/V267I/T275S/A304R/R324M/H343E/V349T/N350E/R353D/I357C/L364R/K379D/A380E/Q388A/P390* |
| 537/538 | N3M/R259K/A304R/A382S | N3M/H14T/T39N/L48F/A64S/V69I/T102S/T127S/I164A/I245M/H255P/R259K/V267I/T275S/A304R/R324M/H343E/V349T/N350E/R353D/I357C/L364R/A380E/A382S/Q388A/P390* |
| 539/540 | R259K/A304R/M324S/Q339A/A382S | H14T/T39N/L48F/A64S/V69I/T102S/T127S/I164A/I245M/H255P/R259K/V267I/T275S/A304R/R324S/Q339A/H343E/V349T/N350E/R353D/I357C/L364R/A380E/A382S/Q388A/P390* |
| 541/542 | R259K/S263T | H14T/T39N/L48F/A64S/V69I/T102S/T127S/I164A/I245M/H255P/R259K/S263T/V267I/T275S/R324M/H343E/V349T/N350E/R353D/I357C/L364R/A380E/Q388A/P390* |
| 543/544 | R259K/A304R/A382S | H14T/T39N/L48F/A64S/V69I/T102S/T127S/I164A/I245M/H255P/R259K/V267I/T275S/A304R/R324M/H343E/V349T/N350E/R353D/I357C/L364R/A380E/A382S/Q388A/P390* |
| 545/546 | N3M/S263T/A304R/M324S/Q339A | N3M/H14T/T39N/L48F/A64S/V69I/T102S/T127S/I164A/I245M/H255P/S263T/V267I/T275S/A304R/R324S/Q339A/H343E/V349T/N350E/R353D/I357C/L364R/A380E/Q388A/P390* |
| 547/548 | N3M/F194L/A304R | N3M/H14T/T39N/L48F/A64S/V69I/T102S/T127S/I164A/F194L/I245M/H255P/V267I/T275S/A304R/R324M/H343E/V349T/N350E/R353D/I357C/L364R/A380E/Q388A/P390* |
| 549/550 | C328N | H14T/T39N/L48F/A64S/V69I/T102S/T127S/I164A/I245M/H255P/V267I/T275S/R324M/C328N/H343E/V349T/N350E/R353D/I357C/L364R/A380E/Q388A/P390* |
| 551/552 | H87R/L270R/Q365E | H14T/T39N/L48F/A64S/V69I/H87R/T102S/T127S/I164A/I245M/H255P/V267I/L270R/T275S/R324M/H343E/V349T/N350E/R353D/I357C/L364R/Q365E/A380E/Q388A/P390* |
| 553/554 | L270R/C328N/P338S | H14T/T39N/L48F/A64S/V69I/T102S/T127S/I164A/I245M/H255P/V267I/L270R/T275S/R324M/C328N/P338S/H343E/V349T/N350E/R353D/I357C/L364R/A380E/Q388A/P390* |
| 555/556 | L270R/C328N/P338S/Q365E | H14T/T39N/L48F/A64S/V69I/T102S/T127S/I164A/I245M/H255P/V267I/L270R/T275S/R324M/C328N/P338S/H343E/V349T/N350E/R353D/I357C/L364R/Q365E/A380E/Q388A/P390* |
| 557/558 | L270R | H14T/T39N/L48F/A64S/V69I/T102S/T127S/I164A/I245M/H255P/V267I/L270R/T275S/R324M/H343E/V349T/N350E/R353D/I357C/L364R/A380E/Q388A/P390* |
| 559/560 | L270R/I319A | H14T/T39N/L48F/A64S/V69I/T102S/T127S/I164A/I245M/H255P/V267I/L270R/T275S/I319A/R324M/H343E/V349T/N350E/R353D/I357C/L364R/A380E/Q388A/P390* |
| 561/562 | H87R/C328N/Q365E | H14T/T39N/L48F/A64S/V69I/H87R/T102S/T127S/I164A/I245M/H255P/V267I/T275S/R324M/C328N/H343E/V349T/N350E/R353D/I357C/L364R/Q365E/A380E/Q388A/P390* |
| 563/564 | Q365E | H14T/T39N/L48F/A64S/V69I/T102S/T127S/I164A/I245M/H255P/V267I/T275S/R324M/H343E/V349T/N350E/R353D/I357C/L364R/Q365E/A380E/Q388A/P390* |
| 565/566 | C168K/L270R/C328N/P338S | H14T/T39N/L48F/A64S/V69I/T102S/T127S/I164A/C168K/I245M/H255P/V267I/L270R/T275S/R324M/C328N/P338S/H343E/V349T/N350E/R353D/I357C/L364R/A380E/Q388A/P390* |
| 567/568 | H87R/L270R | H14T/T39N/L48F/A64S/V69I/H87R/T102S/T127S/I164A/I245M/H255P/V267I/L270R/T275S/R324M/H343E/V349T/N350E/R353D/I357C/L364R/A380E/Q388A/P390* |
| 569/570 | R262G | H14T/T39N/L48F/A64S/V69I/T102S/T127S/I164A/I245M/H255P/V267I/T275S/R324M/H343E/V349T/N350E/R353D/I357C/L364R/A380E/Q388A/P390* |
| 571/572 | T181R | H14T/T39N/L48F/A64S/V69I/T102S/T127S/I164A/T181R/I245M/H255P/R262G/V267I/T275S/R324M/H343E/V349T/N350E/R353D/I357C/L364R/A380E/Q388A/P390* |
| 573/574 | H366T | H14T/T39N/L48F/A64S/V69I/T102S/T127S/I164A/I245M/H255P/V267I/T275S/R324M/H343E/V349T/N350E/R353D/I357C/L364R/H366T/A380E/Q388A/P390* |
| 575/576 | H366Q | H14T/T39N/L48F/A64S/V69I/T102S/T127S/I164A/I245M/H255P/V267I/T275S/R324M/H343E/V349T/N350E/R353D/I357C/L364R/H366Q/A380E/Q388A/P390* |
| 577/578 | E92K | H14T/T39N/L48F/A64S/V69I/E92K/T102S/T127S/I164A/I245M/H255P/V267I/T275S/R324M/H343E/V349T/N350E/R353D/I357C/L364R/A380E/Q388A/P390* |
| 579/580 | T181V | H14T/T39N/L48F/A64S/V69I/T102S/T127S/I164A/T181V/I245M/H255P/V267I/T275S/R324M/H343E/V349T/N350E/R353D/I357C/L364R/A380E/Q388A/P390* |

TABLE 6-1-continued

LDC Variants Based on SEQ ID NO: 484

| SEQ ID NO: (nt/aa) | Amino Acid Differences (Relative to SEQ ID NO: 484) | Amino Acid Differences (Relative to SEQ ID NO: 12) |
|---|---|---|
| 581/582 | F194L | H14T/T39N/L48F/A64S/V69I/T102S/T127S/I164A/F194L/I245M/H255P/V267I/T275S/R324M/H343E/V349T/N350E/R353D/I357C/L364R/A380E/Q388A/P390* |
| 583/584 | A63C | H14T/T39N/L48F/A63C/A64S/V69I/T102S/T127S/I164A/I245M/H255P/V267I/T275S/R324M/H343E/V349T/N350E/R353D/I357C/L364R/A380E/Q388A/P390* |
| 585/586 | Y256W | H14T/T39N/L48F/A64S/V69I/T102S/T127S/I164A/I245M/H255P/Y256W/V267I/T275S/R324M/H343E/V349T/N350E/R353D/I357C/L364R/A380E/Q388A/P390* |
| 587/588 | G156A | H14T/T39N/L48F/A64S/V69I/T102S/T127S/G156A/I164A/I245M/H255P/V267I/T275S/R324M/H343E/V349T/N350E/R353D/I357C/L364R/A380E/Q388A/P390* |
| 589/590 | H366M | H14T/T39N/L48F/A64S/V69I/T102S/T127S/I164A/I245M/H255P/V267I/T275S/R324M/H343E/V349T/N350E/R353D/I357C/L364R/H366M/A380E/Q388A/P390* |
| 591/592 | R262D | H14T/T39N/L48F/A64S/V69I/T102S/T127S/I164A/I245M/H255P/R262D/V267I/T275S/R324M/H343E/V349T/N350E/R353D/I357C/L364R/A380E/Q388A/P390* |
| 593/594 | R262T | H14T/T39N/L48F/A64S/V69I/T102S/T127S/I164A/I245M/H255P/R262T/V267I/T275S/R324M/H343E/V349T/N350E/R353D/I357C/L364R/A380E/Q388A/P390* |
| 595/596 | R262H | H14T/T39N/L48F/A64S/V69I/T102S/T127S/I164A/I245M/H255P/R262H/V267I/T275S/R324M/H343E/V349T/N350E/R353D/I357C/L364R/A380E/Q388A/P390* |
| 597/598 | F194C | H14T/T39N/L48F/A64S/V69I/T102S/T127S/I164A/F194C/I245M/H255P/V267I/T275S/R324M/H343E/V349T/N350E/R353D/I357C/L364R/A380E/Q388A/P390* |
| 599/600 | D126A | H14T/T39N/L48F/A64S/V69I/T102S/D126A/T127S/I164A/I245M/H255P/V267I/T275S/R324M/H343E/V349T/N350E/R353D/I357C/L364R/A380E/Q388A/P390* |
| 601/602 | D352A | H14T/T39N/L48F/A64S/V69I/T102S/T127S/I164A/I245M/H255P/V267I/T275S/R324M/H343E/V349T/N350E/D352A/R353D/I357C/L364R/A380E/Q388A/P390* |
| 603/604 | E201D | H14T/T39N/L48F/A64S/V69I/T102S/T127S/I164A/E201D/I245M/H255P/V267I/T275S/R324M/H343E/V349T/N350E/R353D/I357C/L364R/A380E/Q388A/P390* |
| 605/606 | R16Q | H14T/R16Q/T39N/L48F/A64S/V69I/T102S/T127S/I164A/I245M/H255P/V267I/T275S/R324M/H343E/V349T/N350E/R353D/I357C/L364R/A380E/Q388A/P390* |
| 607/608 | H366L | H14T/T39N/L48F/A64S/V69I/T102S/T127S/I164A/I245M/H255P/V267I/T275S/R324M/H343E/V349T/N350E/R353D/I357C/L364R/H366L/A380E/Q388A/P390* |
| 609/610 | R262S | H14T/T39N/L48F/A64S/V69I/T102S/T127S/I164A/I245M/H255P/R262S/V267I/T275S/R324M/H343E/V349T/N350E/R353D/I357C/L364R/A380E/Q388A/P390* |
| 611/612 | A80K | H14T/T39N/L48F/A64S/V69I/A80K/T102S/T127S/I164A/I245M/H255P/V267I/T275S/R324M/H343E/V349T/N350E/R353D/I357C/L364R/A380E/Q388A/P390* |
| 613/614 | H366V | H14T/T39N/L48F/A64S/V69I/T102S/T127S/I164A/I245M/H255P/V267I/T275S/R324M/H343E/V349T/N350E/R353D/I357C/L364R/H366V/A380E/Q388A/P390* |
| 615/616 | D126T | H14T/T39N/L48F/A64S/V69I/T102S/D126T/T127S/I164A/I245M/H255P/V267I/T275S/R324M/H343E/V349T/N350E/R353D/I357C/L364R/A380E/Q388A/P390* |
| 617/618 | T181K | H14T/T39N/L48F/A64S/V69I/T102S/T127S/I164A/T181K/I245M/H255P/V267I/T275S/R324M/H343E/V349T/N350E/R353D/I357C/L364R/A380E/Q388A/P390* |
| 619/620 | A80G | H14T/T39N/L48F/A64S/V69I/A80G/T102S/T127S/I164A/I245M/H255P/V267I/T275S/R324M/H343E/V349T/N350E/R353D/I357C/L364R/A380E/Q388A/P390* |
| 621/622 | E91A | H14T/T39N/L48F/A64S/V69I/E91A/T102S/T127S/I164A/I245M/H255P/V267I/T275S/R324M/H343E/V349T/N350E/R353D/I357C/L364R/A380E/Q388A/P390* |
| 623/624 | M140V | H14T/T39N/L48F/A64S/V69I/T102S/T127S/M140V/I164A/I245M/H255P/V267I/T275S/R324M/H343E/V349T/N350E/R353D/I357C/L364R/A380E/Q388A/P390* |
| 625/626 | H366A | H14T/T39N/L48F/A64S/V69I/T102S/T127S/I164A/I245M/H255P/V267I/T275S/R324M/H343E/V349T/N350E/R353D/I357C/L364R/H366A/A380E/Q388A/P390* |
| 627/628 | G156S | H14T/T39N/L48F/A64S/V69I/T102S/T127S/I164A/I245M/H255P/V267I/T275S/R324M/H343E/V349T/N350E/R353D/I357C/L364R/A380E/Q388A/P390* |
| 629/630 | E77L | H14T/T39N/L48F/A64S/V69I/E77L/T102S/T127S/G156S/I164A/I245M/H255P/V267I/T275S/R324M/H343E/V349T/N350E/R353D/I357C/L364R/A380E/Q388A/P390* |

TABLE 6-1-continued

| | LDC Variants Based on SEQ ID NO: 484 | |
|---|---|---|
| SEQ ID NO: (nt/aa) | Amino Acid Differences (Relative to SEQ ID NO: 484) | Amino Acid Differences (Relative to SEQ ID NO: 12) |
| 631/632 | E91Q | H14T/T39N/L48F/A64S/V69I/E91Q/T102S/T127S/I164A/ I245M/H255P/V267I/T275S/R324M/H343E/V349T/N350E/ R353D/I357C/L364R/A380E/Q388A/P390* |
| 633/634 | R262I | H14T/T39N/L48F/A64S/V69I/T102S/T127S/I164A/I245M/ H255P/R262I/V267I/T275S/R324M/H343E/V349T/N350E/ R353D/I357C/L364R/A380E/Q388A/P390* |
| 635/636 | R16V | H14T/R16V/T39N/L48F/A64S/V69I/T102S/T127S/I164A/ I245M/H255P/V267I/T275S/R324M/H343E/V349T/N350E/ R353D/I357C/L364R/A380E/Q388A/P390* |

TABLE 7-1

| | LDC Variants Based on SEQ ID NO: 594 | |
|---|---|---|
| SEQ ID NO: (nt/aa) | Amino Acid Differences (Relative to SEQ ID NO: 594) | Amino Acid Differences (Relative to SEQ ID NO: 12) |
| 637/638 | R16Q/M324S/C328N/H366M | H14T/R16Q/T39N/L48F/A64S/V69I/T102S/T127S/I164A/ I245M/H255P/R262T/V267I/T275S/R324S/C328N/H343E/ V349T/N350E/R353D/I357C/L364R/H366M/A380E/Q388A/ P390* |
| 639/640 | R16Q/A63C/A80K/D126T/T181R/ F194C/R259K/M324S/C328N/H366M | H14T/R16Q/T39N/L48F/A63C/A64S/V69I/A80K/A80K/ T102S/D126T/T127S/I164A/T181R/F194C/I245M/H255P/ R259K/R262T/V267I/T275S/R324S/C328N/H343E/ V349T/N350E/R353D/I357C/L364R/H366M/A380E/Q388A/ P390* |
| 641/642 | R16Q/C328N/H366M | H14T/R16Q/T39N/L48F/A64S/V69I/T102S/T127S/I164A/ I245M/H255P/R262T/V267I/T275S/R324M/C328N/H343E/ V349T/N350E/R353D/I357C/L364R/H366M/A380E/Q388A/ P390* |
| 643/644 | A80K/D126T/T181R/L270R/ M324S/H366M | H14T/T39N/L48F/A64S/V69I/A80K/T102S/D126T/T127S/ I164A/T181R/I245M/H255P/R262T/V267I/L270R/T275S/ R324S/H343E/V349T/N350E/R353D/I357C/L364R/H366M/ A380E/Q388A/P390* |
| 645/646 | R16Q/A80K/M324S | H14T/R16Q/T39N/L48F/A64S/V69I/A80K/A80K/T102S/ T127S/I164A/I245M/H255P/R262T/V267I/T275S/R324S/ H343E/V349T/N350E/R353D/I357C/L364R/A380E/Q388A/ P390* |
| 647/648 | R16Q/A80K/D126T/M324S/ H366M | H14T/R16Q/T39N/L48F/A64S/V69I/A80K/T102S/D126T/ T127S/I164A/I245M/H255P/R262T/V267I/T275S/R324S/ H343E/V349T/N350E/R353D/I357C/L364R/H366M/A380E/ Q388A/P390* |
| 649/650 | R16Q/D126T/C168K/H366M | H14T/R16Q/T39N/L48F/A64S/V69I/T102S/D126T/T127S/ I164A/C168K/I245M/H255P/R262T/V267I/T275S/R324M/ H343E/V349T/N350E/R353D/I357C/L364R/H366M/A380E/ Q388A/P390* |
| 651/652 | R16Q/C168K/H366M | H14T/R16Q/R16Q/T39N/L48F/A64S/V69I/T102S/T127S/ I164A/C168K/I245M/H255P/R262T/V267I/T275S/R324M/ H343E/V349T/N350E/R353D/I357C/L364R/H366M/A380E/ Q388A/P390* |
| 653/654 | A80K/D126T/C168K/L270R/ H366M | H14T/T39N/L48F/A64S/V69I/A80K/T102S/D126T/T127S/ I164A/C168K/I245M/H255P/R262T/V267I/L270R/T275S/ R324M/H343E/V349T/N350E/R353D/I357C/L364R/H366M/ A380E/Q388A/P390* |
| 655/656 | R16Q/C168K/M324S/C328N/ H366M | H14T/R16Q/T39N/L48F/A64S/V69I/T102S/T127S/I164A/ C168K/I245M/H255P/R262T/V267I/T275S/R324S/C328N/ H343E/V349T/N350E/R353D/I357C/L364R/H366M/A380E/ Q388A/P390* |
| 657/658 | R16Q/C168K/M324S/H366M | H14T/R16Q/T39N/L48F/A64S/V69I/T102S/T127S/I164A/ C168K/I245M/H255P/R262T/V267I/T275S/R324S/H343E/ V349T/N350E/R353D/I357C/L364R/H366M/A380E/Q388A/ P390* |
| 659/660 | R16Q/R259K/S263T/C328N | H14T/R16Q/T39N/L48F/A64S/V69I/T102S/T127S/I164A/ I245M/H255P/R259K/R262T/S263T/V267I/T275S/R324M/ C328N/H343E/V349T/N350E/R353D/I357C/L364R/A380E/ Q388A/P390* |
| 661/662 | R16Q/A80K/D126T/H366M | H14T/R16Q/T39N/L48F/A64S/V69I/A80K/T102S/D126T/ T127S/I164A/I245M/H255P/R262T/V267I/T275S/R324M/ H343E/V349T/N350E/R353D/I357C/L364R/H366M/A380E/ Q388A/P390* |

TABLE 7-1-continued

LDC Variants Based on SEQ ID NO: 594

| SEQ ID NO: (nt/aa) | Amino Acid Differences (Relative to SEQ ID NO: 594) | Amino Acid Differences (Relative to SEQ ID NO: 12) |
|---|---|---|
| 663/664 | C168K/H366M | H14T/T39N/L48F/A64S/V69I/T102S/T127S/I164A/C168K/I245M/H255P/R262T/V267I/T275S/R324M/H343E/V349T/N350E/R353D/I357C/L364R/H366M/A380E/Q388A/P390* |
| 665/666 | R16Q/A80K/C168K | H14T/R16Q/T39N/L48F/A64S/V69I/A80K/T102S/T127S/I164A/C168K/I245M/H255P/R262T/V267I/T275S/R324M/H343E/V349T/N350E/R353D/I357C/L364R/A380E/Q388A/P390* |
| 667/668 | R16Q/A80K/C168K/L270R/H366M | H14T/R16Q/T39N/L48F/A64S/V69I/A80K/T102S/T127S/I164A/C168K/I245M/H255P/R262T/V267I/L270R/T275S/R324M/H343E/V349T/N350E/R353D/I357C/L364R/H366M/H366M/A380E/Q388A/P390* |
| 669/670 | R16Q/A63C/A80K/D126T/C168K/H366M | H14T/R16Q/T39N/L48F/A63C/A63C/A64S/V69I/A80K/T102S/D126T/T127S/I164A/C168K/I245M/H255P/R262T/V267I/T275S/R324M/H343E/V349T/N350E/R353D/I357C/L364R/H366M/A380E/Q388A/P390* |
| 671/672 | R16Q/E91A/D126T/C168K/M324S/H366M | H14T/R16Q/T39N/L48F/A64S/V69I/E91A/T102S/D126T/T127S/I164A/C168K/I245M/H255P/R262T/V267I/T275S/R324S/H343E/V349T/N350E/R353D/I357C/L364R/H366M/A380E/Q388A/P390* |
| 673/674 | R16Q/A63C/D126T/C168K/L270R/C328N/H366M | H14T/R16Q/T39N/L48F/A63C/A64S/V69I/T102S/D126T/T127S/I164A/C168K/I245M/H255P/R262T/V267I/L270R/T275S/R324M/C328N/H343E/V349T/N350E/R353D/I357C/L364R/H366M/A380E/Q388A/P390* |
| 675/676 | A80K/D126T/C168K/H366M | H14T/T39N/L48F/A64S/V69I/A80K/T102S/D126T/T127S/I164A/C168K/I245M/H255P/R262T/V267I/T275S/R324M/H343E/V349T/N350E/R353D/I357C/L364R/H366M/A380E/Q388A/P390* |
| 677/678 | R16Q/A80K/C168K/H366M | H14T/R16Q/T39N/L48F/A64S/V69I/A80K/T102S/T127S/I164A/C168K/I245M/H255P/R262T/V267I/T275S/R324M/H343E/V349T/N350E/R353D/I357C/L364R/H366M/A380E/Q388A/P390* |
| 679/680 | R16Q/A80K/C168K/M324S | H14T/R16Q/R16Q/T39N/L48F/A64S/V69I/A80K/T102S/T127S/I164A/C168K/I245M/H255P/R262T/V267I/T275S/R324S/H343E/V349T/N350E/R353D/I357C/L364R/A380E/Q388A/P390* |
| 681/682 | R16Q/C168K/L270R/M324S/H366M | H14T/R16Q/T39N/L48F/A64S/V69I/T102S/T127S/I164A/C168K/I245M/H255P/R262T/V267I/L270R/T275S/R324S/H343E/V349T/N350E/R353D/I357C/L364R/H366M/A380E/Q388A/P390* |
| 683/684 | A80K/C168K/L270R/H366M | H14T/T39N/L48F/A64S/V69I/A80K/T102S/T127S/I164A/C168K/I245M/H255P/R262T/V267I/L270R/T275S/R324M/H343E/V349T/N350E/R353D/I357C/L364R/H366M/A380E/Q388A/P390* |
| 685/686 | R16Q/C168K/R259K/H366M | H14T/R16Q/T39N/L48F/A64S/V69I/T102S/T127S/I164A/C168K/I245M/H255P/R259K/R262T/V267I/T275S/R324M/H343E/V349T/N350E/R353D/I357C/L364R/H366M/A380E/Q388A/P390* |

TABLE 8-1

LDC Variants Based on SEQ ID NO: 686

| SEQ ID NO: (nt/aa) | Amino Acid Differences (Relative to SEQ ID NO: 686) | Amino Acid Differences (Relative to SEQ ID NO: 12) |
|---|---|---|
| 687/688 | S66N/T118D/D296E/R300K | H14T/R16Q/T39N/L48F/A64S/S66N/V69I/T102S/T118D/T127S/I164A/C168K/I245M/H255P/R259K/R262T/V267I/T275S/D296E/R300K/R324M/H343E/V349T/N350E/R353D/I357C/L364R/H366M/A380E/Q388A/P390* |
| 689/690 | S66N/T118D/H200S/D296E/A303Q/K317Q | H14T/R16Q/T39N/L48F/A64S/S66N/V69I/T102S/T118D/T127S/I164A/C168K/H200S/I245M/H255P/R259K/R262T/V267I/T275S/D296E/A303Q/K317Q/R324M/H343E/V349T/N350E/R353D/I357C/L364R/H366M/A380E/Q388A/P390* |
| 691/692 | R141P/M144V/A198G/H200S/R300K | H14T/R16Q/T39N/L48F/A64S/V69I/T102S/T127S/R141P/M144V/I164A/C168K/A198G/H200S/I245M/H255P/R259K/R262T/V267I/T275S/R300K/R324M/H343E/V349T/N350E/R353D/I357C/L364R/H366M/A380E/Q388A/P390* |
| 693/694 | S66N/T118D/D296E | H14T/R16Q/T39N/L48F/A64S/S66N/V69I/T102S/T127S/I164A/C168K/I245M/H255P/R259K/R262T/V267I/T275S/D296E/R324M/H343E/V349T/N350E/R353D/I357C/L364R/H366M/A380E/Q388A/P390* |

TABLE 8-1-continued

LDC Variants Based on SEQ ID NO: 686

| SEQ ID NO: (nt/aa) | Amino Acid Differences (Relative to SEQ ID NO: 686) | Amino Acid Differences (Relative to SEQ ID NO: 12) |
|---|---|---|
| 695/696 | A89P/T118D/H200S | H14T/R16Q/T39N/L48F/A64S/V69I/A89P/T102S/T118D/ T127S/I164A/C168K/H200S/I245M/H255P/R259K/R262T/ V267I/T275S/R324M/H343E/V349T/N350E/R353D/I357C/ L364R/H366M/A380E/Q388A/P390* |
| 697/698 | T118D/R141P/H200S | H14T/R16Q/T39N/L48F/A64S/V69I/T102S/T118D/T127S/ R141P/R141P/I164A/C168K/H200S/I245M/H255P/R259K/ R262T/V267I/T275S/R324M/H343E/V349T/N350E/R353D/ I357C/L364R/H366M/A380E/Q388A/P390* |
| 699/700 | R76V/R141P/A198G/H200S/ E201R/R300K | H14T/R16Q/T39N/L48F/A64S/V69I/R76V/T102S/T127S/ R141P/I164A/C168K/A198G/H200S/E201R/I245M/H255P/ R259K/R262T/V267I/T275S/R300K/R324M/H343E/V349T/ N350E/R353D/I357C/L364R/H366M/A380E/Q388A/P390* |
| 701/702 | S66N/R76V/T118D/R141P/ E201R/R300K | H14T/R16Q/T39N/L48F/A64S/S66N/V69I/R76V/T102S/ T118D/T127S/R141P/I164A/C168K/E201R/I245M/H255P/ R259K/R262T/V267I/T275S/R300K/R324M/H343E/V349T/ N350E/R353D/I357C/L364R/H366M/A380E/Q388A/P390* |
| 703/704 | R76V/T118D/R141P/H200S/ D296E | H14T/R16Q/T39N/L48F/A64S/V69I/R76V/T102S/T118D/ T127S/R141P/I164A/C168K/H200S/I245M/H255P/R259K/ R262T/V267I/T275S/D296E/R324M/H343E/V349T/N350E/ R353D/I357C/L364R/H366M/A380E/Q388A/P390* |
| 705/706 | S66N/H200S | H14T/R16Q/T39N/L48F/A64S/S66N/V69I/T102S/T127S/ I164A/C168K/H200S/I245M/H255P/R259K/R262T/V267I/ T275S/R324M/H343E/V349T/N350E/R353D/I357C/L364R/ H366M/A380E/Q388A/P390* |
| 707/708 | S66N/R76V/A198G/H200S/ D296E/A303Q | H14T/R16Q/T39N/L48F/A64S/S66N/V69I/R76V/T102S/ T127S/I164A/C168K/A198G/H200S/I245M/H255P/R259K/ R262T/V267I/T275S/D296E/A303Q/R324M/H343E/V349T/ N350E/R353D/I357C/L364R/H366M/A380E/Q388A/P390* |
| 709/710 | S66N/R76V/A198G/H200S/ R300K | H14T/R16Q/T39N/L48F/A64S/S66N/V69I/R76V/T102S/ T127S/I164A/C168K/A198G/H200S/I245M/H255P/R259K/ R262T/V267I/T275S/R300K/R324M/H343E/V349T/N350E/ R353D/I357C/L364R/H366M/A380E/Q388A/P390* |
| 711/712 | D126T | H14T/R16Q/T39N/L48F/A64S/V69I/T102S/D126T/T127S/ I164A/C168K/I245M/H255P/R259K/R262T/V267I/T275S/ R324M/H343E/V349T/N350E/R353D/I357C/L364R/H366M/ A380E/Q388A/P390* |
| 713/714 | E201D/L270R/D352A | H14T/R16Q/T39N/L48F/A64S/V69I/T102S/T127S/I164A/ C168K/E201D/I245M/H255P/R259K/R262T/V267I/L270R/ T275S/R324M/H343E/V349T/N350E/D352A/R353D/I357C/ L364R/H366M/A380E/Q388A/P390* |
| 715/716 | G156A/L270R/M324S | H14T/R16Q/T39N/L48F/A64S/V69I/T102S/T127S/G156A/ I164A/C168K/I245M/H255P/R259K/R262T/V267I/L270R/ T275S/R324S/H343E/V349T/N350E/R353D/I357C/L364R/ H366M/A380E/Q388A/P390* |
| 717/718 | D126T/E201D/L270R/M324S | H14T/R16Q/T39N/L48F/A64S/V69I/T102S/D126T/T127S/ I164A/C168K/E201D/I245M/H255P/R259K/R262T/V267I/ L270R/T275S/R324S/H343E/V349T/N350E/R353D/I357C/ L364R/H366M/A380E/Q388A/P390* |
| 719/720 | A80K/E201D/L270R | H14T/R16Q/T39N/L48F/A64S/V69I/A80K/T102S/T127S/ I164A/C168K/E201D/I245M/H255P/R259K/R262T/V267I/ L270R/T275S/R324M/H343E/V349T/N350E/R353D/I357C/ L364R/H366M/A380E/Q388A/P390* |
| 721/722 | L270R | H14T/R16Q/T39N/L48F/A64S/V69I/T102S/T127S/I164A/ C168K/I245M/H255P/R259K/R262T/V267I/L270R/T275S/ R324M/H343E/V349T/N350E/R353D/I357C/L364R/H366M/ A380E/Q388A/P390* |
| 723/724 | D126T/L270R | H14T/R16Q/T39N/L48F/A64S/V69I/T102S/D126T/T127S/ I164A/C168K/I245M/H255P/R259K/R262T/V267I/L270R/ T275S/R324M/H343E/V349T/N350E/R353D/I357C/L364R/ H366M/A380E/Q388A/P390* |
| 725/726 | L106M/L270R/M324S/D352A | H14T/R16Q/T39N/L48F/A64S/V69I/T102S/L106M/T127S/ I164A/C168K/I245M/H255P/R259K/R262T/V267I/L270R/ T275S/R324S/H343E/V349T/N350E/D352A/R353D/I357C/ L364R/H366M/A380E/Q388A/P390* |
| 727/728 | L270R/M324S | H14T/R16Q/T39N/L48F/A64S/V69I/T102S/T127S/I164A/ C168K/I245M/H255P/R259K/R262T/V267I/L270R/T275S/ R324S/H343E/V349T/N350E/R353D/I357C/L364R/H366M/ A380E/Q388A/P390* |
| 729/730 | G156A/L270R | H14T/R16Q/T39N/L48F/A64S/V69I/T102S/T127S/G156A/ I164A/C168K/I245M/H255P/R259K/R262T/V267I/L270R/ T275S/R324M/H343E/V349T/N350E/R353D/I357C/L364R/ H366M/A380E/Q388A/P390* |

TABLE 8-1-continued

LDC Variants Based on SEQ ID NO: 686

| SEQ ID NO: (nt/aa) | Amino Acid Differences (Relative to SEQ ID NO: 686) | Amino Acid Differences (Relative to SEQ ID NO: 12) |
|---|---|---|
| 731/732 | E201D/L270R | H14T/R16Q/T39N/L48F/A64S/V69I/T102S/T127S/I164A/ C168K/E201D/I245M/H255P/R259K/R262T/V267I/L270R/ T275S/R324M/H343E/V349T/N350E/R353D/I357C/L364R/ H366M/A380E/Q388A/P390* |
| 733/734 | A80K/L270R/M324S | H14T/R16Q/T39N/L48F/A64S/V69I/A80K/T102S/T127S/ I164A/C168K/I245M/H255P/R259K/R262T/V267I/L270R/ T275S/R324S/H343E/V349T/N350E/R353D/I357C/L364R/ H366M/A380E/Q388A/P390* |
| 735/736 | A80K/L270R | H14T/R16Q/T39N/L48F/A64S/V69I/A80K/T102S/T127S/ I164A/C168K/I245M/H255P/R259K/R262T/V267I/L270R/ T275S/R324M/H343E/V349T/N350E/R353D/I357C/L364R/ H366M/A380E/Q388A/P390* |

TABLE 8-2

LDC Variants Based on SEQ ID NO: 686

| SEQ ID NO: (nt/aa) | Amino Acid Differences (Relative to SEQ ID NO: 686) | Amino Acid Differences (Relative to SEQ ID NO: 12) |
|---|---|---|
| 737/738 | L19I | H14T/L19I/R16Q/T39N/L48F/A64S/V69I/T102S/T127S/ I164A/C168K/I245M/H255P/R259K/R262T/V267I/T275S/ R324M/H343E/V349T/N350E/R353D/I357C/L364R/H366M/ A380E/Q388A/P390* |
| 739/740 | N134S | H14T/R16Q/T39N/L48F/A64S/V69I/T102S/T127S/N134S/ I164A/C168K/I245M/H255P/R259K/R262T/V267I/T275S/ R324M/H343E/V349T/N350E/R353D/I357C/L364R/H366M/ A380E/Q388A/P390* |
| 741/742 | F173T | H14T/R16Q/T39N/L48F/A64S/V69I/T102S/T127S/I164A/ C168K/F173T/I245M/H255P/R259K/R262T/V267I/T275S/ R324M/H343E/V349T/N350E/R353D/I357C/L364R/H366M/ A380E/Q388A/P390* |
| 743/744 | P170A | H14T/R16Q/T39N/L48F/A64S/V69I/T102S/T127S/I164A/ C168K/P170A/I245M/H255P/R259K/R262T/V267I/T275S/ R324M/H343E/V349T/N350E/R353D/I357C/L364R/H366M/ A380E/Q388A/P390* |
| 745/746 | Y123M | H14T/R16Q/T39N/L48F/A64S/V69I/T102S/Y123M/T127S/ I164A/C168K/I245M/H255P/R259K/R262T/V267I/T275S/ R324M/H343E/V349T/N350E/R353D/I357C/L364R/H366M/ A380E/Q388A/P390* |
| 747/748 | V187L | H14T/R16Q/T39N/L48F/A64S/V69I/T102S/T127S/I164A/ C168K/V187L/I245M/H255P/R259K/R262T/V267I/T275S/ R324M/H343E/V349T/N350E/R353D/I357C/L364R/H366M/ A380E/Q388A/P390* |
| 749/750 | A211S | H14T/R16Q/T39N/L48F/A64S/V69I/T102S/T127S/I164A/ C168K/A211S/I245M/H255P/R259K/R262T/V267I/T275S/ R324M/H343E/V349T/N350E/R353D/I357C/L364R/H366M/ A380E/Q388A/P390* |
| 751/752 | F173I | H14T/R16Q/T39N/L48F/A64S/V69I/T102S/T127S/I164A/ C168K/F173I/I245M/H255P/R259K/R262T/V267I/T275S/ R324M/H343E/V349T/N350E/R353D/I357C/L364R/H366M/ A380E/Q388A/P390* |
| 753/754 | L109G | H14T/R16Q/T39N/L48F/A64S/V69I/T102S/L109G/T127S/ I164A/C168K/I245M/H255P/R259K/R262T/V267I/T275S/ R324M/H343E/V349T/N350E/R353D/I357C/L364R/H366M/ A380E/Q388A/P390* |
| 755/756 | N134A | H14T/R16Q/T39N/L48F/A64S/V69I/T102S/T127S/N134A/ I164A/C168K/I245M/H255P/R259K/R262T/V267I/T275S/ R324M/H343E/V349T/N350E/R353D/I357C/L364R/H366M/ A380E/Q388A/P390* |
| 757/758 | T312A | H14T/R16Q/T39N/L48F/A64S/V69I/T102S/T127S/I164A/ C168K/I245M/H255P/R259K/R262T/V267I/T275S/T312A/ R324M/H343E/V349T/N350E/R353D/I357C/L364R/H366M/ A380E/Q388A/P390* |
| 759/760 | Y123V | H14T/R16Q/T39N/L48F/A64S/V69I/T102S/Y123V/T127S/ I164A/C168K/I245M/H255P/R259K/R262T/V267I/T275S/ R324M/H343E/V349T/N350E/R353D/I357C/L364R/H366M/ A380E/Q388A/P390* |
| 761/762 | F173A | H14T/R16Q/T39N/L48F/A64S/V69I/T102S/T127S/I164A/ C168K/F173A/I245M/H255P/R259K/R262T/V267I/T275S/ R324M/H343E/V349T/N350E/R353D/I357C/L364R/H366M/ A380E/Q388A/P390* |

TABLE 8-2-continued

LDC Variants Based on SEQ ID NO: 686

| SEQ ID NO: (nt/aa) | Amino Acid Differences (Relative to SEQ ID NO: 686) | Amino Acid Differences (Relative to SEQ ID NO: 12) |
|---|---|---|
| 445/446 | Y123F | H14T/R16Q/T39N/L48F/A64S/V69I/T102S/Y123F/T127S/ I164A/C168K/I245M/H255P/R259K/R262T/V267I/T275S/ R324M/H343E/V349T/N350E/R353D/I357C/L364R/H366M/ A380E/Q388A/P390* |

TABLE 10-1

LDC Variants Based on SEQ ID NO: 688

| SEQ ID NO: (nt/aa) | Amino Acid Differences (Relative to SEQ ID NO: 688) | Amino Acid Differences (Relative to SEQ ID NO: 12) |
|---|---|---|
| 763/764 | L19I/L109G/A211S/L270R/ T312A | H14T/R16Q/L19I/T39N/L48F/A64S/S66N/V69I/T102S/ L109G/T118D/T127S/I164A/C168K/A211S/I245M/H255P/ R259K/R262T/V267I/L270R/T275S/D296E/R300K/T312A/ R324M/H343E/V349T/N350E/R353D/I357C/L364R/H366M/ A380E/Q388A/P390* |
| 765/766 | L19I/L109G/Y123F/P170A/ A211S/L270R/T312A | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270R/T275S/D296E/ R300K/T312A/R324M/H343E/V349T/N350E/R353D/I357C/ L364R/H366M/A380E/Q388A/P390* |
| 767/768 | L19I/L109G/Y123V/R141P/ P170A/A198G/A211S/L270R/ T312A | H14T/R16Q/L19I/T39N/L48F/A64S/S66N/V69I/T102S/ L109G/T118D/Y123V/T127S/R141P/I164A/C168K/P170A/ A198G/A211S/I245M/H255P/R259K/R262T/V267I/L270R/ T275S/D296E/R300K/T312A/R324M/H343E/V349T/N350E/ R353D/I357C/L364R/H366M/A380E/Q388A/P390* |
| 769/770 | L19I/L109G/P170A/F173L/ A211S/L270R/T312A | H14T/R16Q/L19I/T39N/L48F/A64S/S66N/V69I/T102S/ L109G/T118D/T127S/I164A/C168K/P170A/F173I/A211S/ I245M/H255P/R259K/R262T/V267I/L270R/T275S/D296E/ R300K/T312A/R324M/H343E/V349T/N350E/R353D/I357C/ L364R/H366M/A380E/Q388A/P390* |
| 771/772 | L109G/A211S/L270R/T312A | H14T/R16Q/T39N/L48F/A64S/S66N/V69I/T102S/L109G/ T118D/T127S/I164A/C168K/A211S/I245M/H255P/R259K/ R262T/V267I/L270R/T275S/D296E/R300K/T312A/R324M/ H343E/V349T/N350E/R353D/I357C/L364R/H366M/A380E/ Q388A/P390* |
| 773/774 | L19I/L109G/Y123F/A198G/ H200S/A211S/L270R/T312A | H14T/R16Q/L19I/T39N/L48F/A64S/S66N/V69I/T102S/ L109G/T118D/Y123F/T127S/I164A/C168K/A198G/H200S/ A211S/I245M/H255P/R259K/R262T/V267I/L270R/T275S/ D296E/R300K/T312A/R324M/H343E/V349T/N350E/R353D/ I357C/L364R/H366M/A380E/Q388A/P390* |
| 775/776 | L109G/P170A/A211S/L270R/ T312A | H14T/R16Q/T39N/L48F/A64S/S66N/V69I/T102S/L109G/ T118D/T127S/I164A/C168K/P170A/A211S/I245M/H255P/ R259K/R262T/V267I/L270R/T275S/D296E/R300K/T312A/ R324M/H343E/V349T/N350E/R353D/I357C/L364R/H366M/ A380E/Q388A/P390* |
| 777/778 | L19I/L109G/Y123V/R141P/ P170A/A198G/H200S/A211S/ L270R/T312A | H14T/R16Q/L19I/T39N/L48F/A64S/S66N/V69I/T102S/ L109G/T118D/Y123V/T127S/R141P/I164A/C168K/P170A/ A198G/H200S/A211S/I245M/H255P/R259K/R262T/V267I/ L270R/T275S/D296E/R300K/T312A/R324M/H343E/V349T/ N350E/R353D/I357C/L364R/H366M/A380E/Q388A/P390* |
| 779/780 | L19I/L109G/Y123V/R141P/ P170A/A198G/A211S | H14T/R16Q/L19I/T39N/L48F/A64S/S66N/V69I/T102S/ L109G/T118D/Y123V/T127S/R141P/I164A/C168K/P170A/ A198G/A211S/I245M/H255P/R259K/R262T/V267I/T275S/ D296E/R300K/R324M/H343E/V349T/N350E/R353D/I357C/ L364R/H366M/A380E/Q388A/P390* |

TABLE 11-1

LDC Variants Based on SEQ ID NO: 766

| SEQ ID NO: (nt/aa) | Amino Acid Differences (Relative to SEQ ID NO: 766) | Amino Acid Differences (Relative to SEQ ID NO: 12) |
|---|---|---|
| 781/782 | K5V/H41D | K5V/H14T/R16Q/L19I/T39N/H41D/L48F/A64S/S66N/ V69I/T102S/L109G/T118D/Y123F/T127S/I164A/C168K/ P170A/A211S/I245M/H255P/R259K/R262T/V267I/L270R/ T275S/D296E/R300K/T312A/R324M/H343E/V349T/N350E/ R353D/I357C/L364R/H366M/A380E/Q388A/P390* |
| 783/784 | K5V/H41D/T228D | H14T/R16Q/L19I/T39N/H41D/L48F/A64S/S66N/V69I/ T102S/L109G/T118D/Y123F/T127S/I164A/C168K/P170A/ A211S/T228D/I245M/H255P/R259K/R262T/V267I/L270R/ T275S/D296E/R300K/T312A/R324M/H343E/V349T/N350E/ R353D/I357C/L364R/H366M/A380E/Q388A/P390* |
| 785/786 | H41D | H14T/R16Q/L19I/T39N/H41D/L48F/A64S/S66N/V69I/ T102S/L109G/T118D/Y123F/T127S/I164A/C168K/P170A/ A211S/I245M/H255P/R259K/R262T/V267I/L270R/T275S/ D296E/R300K/T312A/R324M/H343E/V349T/N350E/R353D/ I357C/L364R/H366M/A380E/Q388A/P390* |
| 787/788 | T331V | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270R/T275S/D296E/ R300K/T312A/R324M/T331V/H343E/V349T/N350E/R353D/ I357C/L364R/H366M/A380E/Q388A/P390* |
| 789/790 | D353I | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270R/T275S/D296E/ R300K/T312A/R324M/H343E/V349T/N350E/R353I/I357C/ L364R/H366M/A380E/Q388A/P390* |
| 791/792 | V55I | H14T/R16Q/L19I/T39N/L48F/V55I/A64S/S66N/V69I/ T102S/L109G/T118D/Y123F/T127S/I164A/C168K/P170A/ A211S/I245M/H255P/R259K/R262T/V267I/L270R/T275S/ D296E/R300K/T312A/R324M/H343E/V349T/N350E/R353D/ I357C/L364R/H366M/A380E/Q388A/P390* |
| 793/794 | S64N | H14T/R16Q/L19I/T39N/L48F/A64N/S66N/V69I/T102S/ L109G/T118D/Y123F/T127S/I164A/C168K/P170A/A211S/ I245M/H255P/R259K/R262T/V267I/L270R/T275S/D296E/ R300K/T312A/R324M/H343E/V349T/N350E/R353D/I357C/ L364R/H366M/A380E/Q388A/P390* |
| 795/796 | L47F | H14T/R16Q/L19I/T39N/L47F/L48F/A64S/S66N/V69I/ T102S/L109G/T118D/Y123F/T127S/I164A/C168K/P170A/ A211S/I245M/H255P/R259K/R262T/V267I/L270R/T275S/ D296E/R300K/T312A/R324M/H343E/V349T/N350E/R353D/ I357C/L364R/H366M/A380E/Q388A/P390* |
| 797/798 | L51E | H14T/R16Q/L19I/T39N/L48F/L51E/A64S/S66N/V69I/ T102S/L109G/T118D/Y123F/T127S/I164A/C168K/P170A/ A211S/I245M/H255P/R259K/R262T/V267I/L270R/T275S/ D296E/R300K/T312A/R324M/H343E/V349T/N350E/R353D/ I357C/L364R/H366M/A380E/Q388A/P390* |
| 799/800 | D353L | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270R/T275S/D296E/ R300K/T312A/R324M/H343E/V349T/N350E/R353L/I357C/ L364R/H366M/A380E/Q388A/P390* |
| 801/802 | L51Q | H14T/R16Q/L19I/T39N/L48F/L51Q/A64S/S66N/V69I/ T102S/L109G/T118D/Y123F/T127S/I164A/C168K/P170A/ A211S/I245M/H255P/R259K/R262T/V267I/L270R/T275S/ D296E/R300K/T312A/R324M/H343E/V349T/N350E/R353D/ I357C/L364R/H366M/A380E/Q388A/P390* |
| 803/804 | P384W | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270R/T275S/D296E/ R300K/T312A/R324M/H343E/V349T/N350E/R353D/I357C/ L364R/H366M/A380E/P384W/Q388A/P390* |
| 805/806 | C357S | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270R/T275S/D296E/ R300K/T312A/R324M/H343E/V349T/N350E/R353D/I357S/ L364R/H366M/A380E/Q388A/P390* |
| 807/808 | I267L | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270R/T275S/I267L/ D296E/R300K/T312A/R324M/H343E/V349T/N350E/R353D/ I357C/L364R/H366M/A380E/Q388A/P390* |
| 809/810 | D126A | H14T/R16Q/L19I/T39N/L48F/A64S/S66N/V69I/T102S/ L109G/T118D/Y123F/D126A/T127S/I164A/C168K/P170A/ A211S/I245M/H255P/R259K/R262T/V267I/L270R/T275S/ D296E/R300K/T312A/R324M/H343E/V349T/N350E/R353D/ I357C/L364R/H366M/A380E/Q388A/P390* |

TABLE 11-1-continued

| | LDC Variants Based on SEQ ID NO: 766 | |
|---|---|---|
| SEQ ID NO: (nt/aa) | Amino Acid Differences (Relative to SEQ ID NO: 766) | Amino Acid Differences (Relative to SEQ ID NO: 12) |
| 811/812 | F33L | H14T/R16Q/L19I/F33L/T39N/L48F/A64S/S66N/V69I/ T102S/L109G/T118D/Y123F/T127S/I164A/C168K/P170A/ A211S/I245M/H255P/R259K/R262T/V267I/L270R/T275S/ D296E/R300K/T312A/R324M/H343E/V349T/N350E/R353D/ I357C/L364R/H366M/A380E/Q388A/P390* |
| 813/814 | D126T | H14T/R16Q/L19I/T39N/L48F/A64S/S66N/V69I/T102S/ L109G/T118D/Y123F/D126T/T127S/I164A/C168K/P170A/ A211S/I245M/H255P/R259K/R262T/V267I/L270R/T275S/ D296E/R300K/T312A/R324M/H343E/V349T/N350E/R353D/ I357C/L364R/H366M/A380E/Q388A/P390* |
| 815/816 | R270T | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270T/T275S/D296E/ R300K/T312A/R324M/H343E/V349T/N350E/R353D/I357C/ L364R/H366M/A380E/Q388A/P390* |
| 817/818 | R270A | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270A/T275S/D296E/ R300K/T312A/R324M/H343E/V349T/N350E/R353D/I357C/ L364R/H366M/A380E/Q388A/P390* |
| 819/820 | E265P | H14T/R16Q/L19I/T39N/L48F/A64S/S66N/V69I/T102S/ L109G/T118D/Y123F/T127S/I164A/C168K/P170A/A211S/ I245M/H255P/R259K/R262T/E265P/V267I/L270R/T275S/ D296E/R300K/T312A/R324M/H343E/V349T/N350E/R353D/ I357C/L364R/H366M/A380E/Q388A/P390* |
| 821/822 | D353E | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270R/T275S/D296E/ R300K/T312A/R324M/H343E/V349T/N350E/R353E/I357C/ L364R/H366M/A380E/Q388A/P390* |

TABLE 11-2

| | LDC Variants Based on SEQ ID NO: 766 | |
|---|---|---|
| SEQ ID NO: (nt/aa) | Amino Acid Differences (Relative to SEQ ID NO: 766) | Amino Acid Differences (Relative to SEQ ID NO: 12) |
| 823/824 | D118T/K300R | H14T/R16Q/L19I/T39N/L48F/A64S/S66N/V69I/T102S/ L109G/Y123F/T127S/I164A/C168K/P170A/A211S/I245M/ H255P/R259K/R262T/V267I/L270R/T275S/D296E/T312A/ R324M/H343E/V349T/N350E/R353D/I357C/L364R/H366M/ A380E/Q388A/P390* |
| 825/826 | D118T | H14T/R16Q/L19I/T39N/L48F/A64S/S66N/V69I/T102S/ L109G/Y123F/T127S/I164A/C168K/P170A/A211S/I245M/ H255P/R259K/R262T/V267I/L270R/T275S/D296E/R300K/ T312A/R324M/H343E/V349T/N350E/R353D/I357C/L364R/ H366M/A380E/Q388A/P390* |
| 827/828 | N66S | H14T/R16Q/L19I/T39N/L48F/A64S/V69I/T102S/L109G/ T118D/Y123F/T127S/I164A/C168K/P170A/A211S/I245M/ H255P/R259K/R262T/V267I/L270R/T275S/D296E/R300K/ T312A/R324M/H343E/V349T/N350E/R353D/I357C/L364R/ H366M/A380E/Q388A/P390* |
| 829/830 | E296D | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270R/T275S/R300K/ T312A/R324M/H343E/V349T/N350E/R353D/I357C/L364R/ H366M/A380E/Q388A/P390* |
| 831/832 | N66S/D118T | H14T/R16Q/L19I/T39N/L48F/A64S/V69I/T102S/L109G/ Y123F/T127S/I164A/C168K/P170A/A211S/I245M/H255P/ R259K/R262T/V267I/L270R/T275S/D296E/R300K/T312A/ R324M/H343E/V349T/N350E/R353D/I357C/L364R/H366M/ A380E/Q388A/P390* |
| 833/834 | K300R | H14T/R16Q/L19I/T39N/L48F/A64S/S66N/V69I/T102S/ L109G/T118D/Y123F/T127S/I164A/C168K/P170A/A211S/ I245M/H255P/R259K/R262T/V267I/L270R/T275S/D296E/ T312A/R324M/H343E/V349T/N350E/R353D/I357C/L364R/ H366M/A380E/Q388A/P390* |

TABLE 11-2-continued

LDC Variants Based on SEQ ID NO: 766

| SEQ ID NO: (nt/aa) | Amino Acid Differences (Relative to SEQ ID NO: 766) | Amino Acid Differences (Relative to SEQ ID NO: 12) |
|---|---|---|
| 835/836 | N66S/D118T/E296D | H14T/R16Q/L19I/T39N/L48F/A64S/V69I/T102S/L109G/Y123F/T127S/I164A/C168K/P170A/A211S/I245M/H255P/R259K/R262T/V267I/L270R/T275S/R300K/T312A/R324M/H343E/V349T/N350E/R353D/I357C/L364R/H366M/A380E/Q388A/P390* |
| 837/838 | E296D/K300R | H14T/R16Q/L19I/T39N/L48F/A64S/S66N/V69I/T102S/L109G/T118D/Y123F/T127S/I164A/C168K/P170A/A211S/I245M/H255P/R259K/R262T/V267I/L270R/T275S/T312A/R324M/H343E/V349T/N350E/R353D/I357C/L364R/H366M/A380E/Q388A/P390* |
| 839/840 | N66S/E296D/K300R | H14T/R16Q/L19I/T39N/L48F/A64S/V69I/T102S/L109G/T118D/Y123F/T127S/I164A/C168K/P170A/A211S/I245M/H255P/R259K/R262T/V267I/L270R/T275S/T312A/R324M/H343E/V349T/N350E/R353D/I357C/L364R/H366M/A380E/Q388A/P390* |
| 841/842 | N66S/E296D | H14T/R16Q/L19I/T39N/L48F/A64S/V69I/T102S/L109G/T118D/Y123F/T127S/I164A/C168K/P170A/A211S/I245M/H255P/R259K/R262T/V267I/L270R/T275S/R300K/T312A/R324M/H343E/V349T/N350E/R353D/I357C/L364R/H366M/A380E/Q388A/P390* |
| 843/844 | N66S/K300R | H14T/R16Q/L19I/T39N/L48F/A64S/V69I/T102S/L109G/T118D/Y123F/T127S/I164A/C168K/P170A/A211S/I245M/H255P/R259K/R262T/V267I/L270R/T275S/D296E/T312A/R324M/H343E/V349T/N350E/R353D/I357C/L364R/H366M/A380E/Q388A/P390* |
| 845/846 | D118T/E296D | H14T/R16Q/L19I/T39N/L48F/A64S/S66N/V69I/T102S/L109G/Y123F/T127S/I164A/C168K/P170A/A211S/I245M/H255P/R259K/R262T/V267I/L270R/T275S/R300K/T312A/R324M/H343E/V349T/N350E/R353D/I357C/L364R/H366M/A380E/Q388A/P390* |
| 847/848 | N66S/D118T/E296D/K300R | H14T/R16Q/L19I/T39N/L48F/A64S/V69I/T102S/L109G/Y123F/T127S/I164A/C168K/P170A/A211S/I245M/H255P/R259K/R262T/V267I/L270R/T275S/T312A/R324M/H343E/V349T/N350E/R353D/I357C/L364R/H366M/A380E/Q388A/P390* |
| 849/850 | N66S/D118T/K300R | H14T/R16Q/L19I/T39N/L48F/A64S/V69I/T102S/L109G/Y123F/T127S/I164A/C168K/P170A/A211S/I245M/H255P/R259K/R262T/V267I/L270R/T275S/D296E/T312A/R324M/H343E/V349T/N350E/R353D/I357C/L364R/H366M/A380E/Q388A/P390* |
| 851/852 | D118T/E296D/K300R | H14T/R16Q/L19I/T39N/L48F/A64S/S66N/V69I/T102S/L109G/Y123F/T127S/I164A/C168K/P170A/A211S/I245M/H255P/R259K/R262T/V267I/L270R/T275S/T312A/R324M/H343E/V349T/N350E/R353D/I357C/L364R/H366M/A380E/Q388A/P390* |

SEQUENCE LISTING (1064 sequences)

SEQ ID NO: 1 - DNA, 1701 bp, synthetic construct
  misc_feature 1..1701: note = Wild Type Amino Acid Decarboxylase from Streptomyces sp. GP55
  source 1..1701: mol_type = other DNA
atgagcatttcatcttctccgctggatatcttagcggcggcctccgcagtggacagcggcccagccgttgatccgggtcctgaactggattgccgcgactttgagcttccggcttcggggttggatgatgcacgtcgtctgcatgtcctggataccgtggacgaatatctgacgcgtaaacgtcgccacctggttggttaccaggctacccaagacatgcagggctgtgcgctcgatttagcacgtttcatgcccaacaacatcaataatcttggcgatccgtttcagagtggaggatataaaccaaacactaaggtagtagaacgcgccgtgctggactactacgcgaaattatggcgcgctaatggtccgcatgatcctgcggatccggagagctattggggctatatgttgtcgatgggtagtacagaaggcaacatgtatgccctctggaatgcacgcgactacctctccgggaaagcgctgattcaaccacccaccgccccgttcgaagcgctgcgctatgtcaaagcacgtccggatcgcagcaaccctaatgctcaccgtccggtggccttctactcagaagacacgcattattcgtttgcgaaggcagttcgcgtcctgggtgtggagacctttcacgctgttggctgggaattgtacccggatgaatgcccactggtggatccggccactggccgtcgtgagtggcccattgaagtaccgagttctcctggtccgtcaggtacgtcctgggatgggccaggcgaaatcgacgtcgatagcctggcggtgctggtcgagttctttgcagcgaaaggtcatccgatttttgtgaaccttaacttgggaagcaccttcaaaggcgcccatgacgatgttcgcggcgtttgtgaacgcctgctgccgatctttgaagaacacgggctcattcagcgtgaggtggtgtatggtacagatcgtcgtaccggcgaacctttagtagacttacgccgcggtttctggatccatgttgatggcgcccttggtgcgggatatgcgccatttatgcgcatggctagtcaggacccggcagcacacggttggacgcccgatgtcgagttgccggaatacgattttggcttaacccttccgactcgtgaattcggtgacctcgatatggtgtcgtcgattgccatgagcggccataaatggcctggcgccccatggccttgcgggatttatatgacgaaggttaaataccaaatctctccgccgtcccagccggactataccggtgctccagatacaacatttgccgggagccgtaacggtttctctccgttggtcatttgggatcacctttcacgccatagttaccaggatcaagtagatcgtatccgtgacgcacaggccttggctgactatctcgaatgtcgcttacgtgcaatggaaggagagttaggcgtggaattgtggccagctcgtactccgggtgccgttaccgtgcgctttcgcaaacctagcgcagaactcgtagccaaatggtcacttagctcccaagacgtcttaatggttccgggcgatgagatgacccgtcgttcgtacgtgcatgtcttcttgatgcccagtgttgatcgcgcaaaattggatgccctccttgctgaattagctgaagatccggcaattcgcggtttacccgcccgttctgcataatag

SEQ ID NO: 2 - protein, 565 aa, synthetic construct
  REGION 1..565: note = Wild Type Amino Acid Decarboxylase from Streptomyces sp. GP55
MSISSSPLDILAAASAVDSGPAVDPGPELDCRDFELPASGLDDARRLHVLDTVDEYLTRKRRHLVGYQATQDMQGCALDLARFMPNNINNLGDPFQSGGYKPNTKVVERAVLDYYAKLWRANGPHDPADPESYWGYMLSMGSTEGNMYALWNARDYLSGKALIQPPTAPFEALRYVKARPDRSNPNAHRPVAFYSEDTHYSFAKAVRVLGVETFHAVGWELYPDECPLVDPATGRREWPIEVPSSPGPSGTSWDGPGEIDVDSLAVLVEFFAAKGHPIFVNLNLGSTFKGAHDDVRGVCERLLPIFEEHGLIQREVVYGTDRRTGEPLVDLRRGFWIHVDGALGAGYAPFMRMASQDPAAHGWTPDVELPEYDFGLTLPTREFGDLDMVSSIAMSGHKWPGAPWPCGIYMTKVKYQISPPSQPDYTGAPDTTFAGSRNGFSPLVIWDHLSRHSYQDQVDRIRDAQALADYLECRLRAMEGELGVELWPARTPGAVTVRFRKPSAELVAKWSLSSQDVLMVPGDEMTRRSYVHVFLMPSVDRAKLDALLAELAEDPAIRGLPARSA

SEQ ID NO: 3 - DNA, 1722 bp, synthetic construct
  misc_feature 1..1722: note = Wild Type Amino Acid Decarboxylase from Saccharothrix sp. ST-888
  source 1..1722: mol_type = other DNA
atgagtcgtaccgatactctgacggtgcatattggtcacgacgaattagctcgcccggatgttctgatcccaccattggatggccctgggctgtgcgtaccgcagggacctgcggagcccgacgtctgtgactttgaactccctgcaggtggcctggatgatgaacagcgtttacgcgcactggataccatggacgagtatctgacaggtaaacgccgctaccttctcggctatcaggcaacccaggaaatgggtggaagcgcgttcgatttaggccgttttatgcagcataacattaataatttgggtgatcccttccaatctggcgggtacaaaccaaacactaaggtggtggaacgtgccgttctggactattatgcggcgttatggcacgctaaaggcccctacaacgccgatgatccacagtcgtattggggctacgtcctttcaatgggtagcacggagggcaatatgtatgcattgtggaacgcgcgtgactacctctccggtaaagccttaatccagccacctaccggtcccagtggcgcgttgcgctatgttcaagcaccttctgaaccatccaaccccaatgcttaccgtcctgtggccttctatagcgaagacacgcattacagctttgcgaaagcagtacacgtgcttggagtcgagacctttcatgctgttggcacagaacagtatccagatgagtgccctttagcaggtccaaccgcggaacctcgcgaatggccagcggaagtaccctcacgctcgggtccttcgggccatagttgggatggcacgggagagattgatatcgatgctctcgcagtgttggtcgaattctttgcggcgaaaggtcaccccatttttgtgagcctcaacttaggctccactttcaagggcgctcatgacgacgttcgtcaagtgtgtgaacgccttctccccatctttgagaaacacggtttggttcagggtgaagtcgtctatggcaaagatccagtgaccggcgaacctcttgttgatttgcgtcgtcgcttctggattcatgtagatggagcattaggtgcgggatacgcgccatttatgcgcatggctgacgcagatccagcgggctttggttggacacctgacacccgtgtgcccgaattcgattttggcatcaccttaccaactcgcgagttcggtgacctcgatatggtgagcagcattgcgatgtctggccacaaatggcctggtgcaccatggccctgcggcatctatatgacgaaggtcaaataccagatttcgcctccttcccaacccgattatattggtgctccagacaccacgtttgcaggctcacgtaatggattctcaccccttgttttgtgggatcatcttagtcgccattcttaccgtgatcaggtagatcgcatccgtcgtgcgcaagaattagcggcgtacctcgaacagcagttgcgctttttagaacgcgagaaagacattgaattatggccagctcgtacgcccggcgcaatcaccgtgcgctttcgtaaacctagtccagaactcgttgctaagtggagcttgtcgtcgcaagatgtgcttttggttcctggtgacgagaccacacgtcgcagctatgtccacgtgttcctcatgtcctccgtagatcgtgcgaaacttgacgcgctcttggaagatcttggcaatgatcccgcagttttacgccgcccataatag

SEQ ID NO: 4 - protein, 572 aa, synthetic construct
  REGION 1..572: note = Wild Type Amino Acid Decarboxylase from Saccharothrix sp. ST-888
MSRTDTLTVHIGHDELARPDVLIPPLDGPGLCVPQGPAEPDVCDFELPAGGLDDEQRLRALDTMDEYLTGKRRYLLGYQATQEMGGSAFDLGRFMQHNINNLGDPFQSGGYKPNTKVVERAVLDYYAALWHAKGPYNADDPQSYWGYVLSMGSTEGNMYALWNARDYLSGKALIQPPTGPSGALRYVQAPSEPSNPNAYRPVAFYSEDTHYSFAKAVHVLGVETFHAVGTEQYPDECPLAGPTAEPREWPAEVPSRSGPSGHSWDGTGEIDIDALAVLVEFFAAKGHPIFVSLNLGSTFKGAHDDVRQVCERLLPIFEKHGLVQGEVVYGKDPVTGEPLVDLRRRFWIHVDGALGAGYAPFMRMADADPAGFGWTPDTRVPEFDFGITLPTREFGDLDMVSSIAMSGHKWPGAPWPCGIYMTKVKYQISPPSQPDYIGAPDTTFAGSRNGFSPLVLWDHLSRHSYRDQVDRIRRAQELAAYLEQQLRFLEREKDIELWPARTPGAITVRFRKPSPELVAKWSLSSQDVLLVPGDETTRRSYVHVFLMSSVDRAKLDALLEDLGNDPAVLRRP

SEQ ID NO: 5 - DNA, 1779 bp, synthetic construct
  misc_feature 1..1779: note = Wild Type Amino Acid Decarboxylase from Kitasatospora sp. MBT63
  source 1..1779: mol_type = other DNA
atgcgtcgtaccgatacgttaacattggacctgggtcatggccacggtgcgccggcacgcagcgatgcccgcatgtcaccacttggcgtgccggctcaggcaagtgcgccttctccggccccgggcggaccactcgcgcctgctgaagaaccggcgctgtgcgactttctgctgccggcagatgggctggatgatgagcaacgtttacgcgcattggacactatggatgcctatctgaccggtaaacgccgctacctgctgggctatcaggcaacccaggaaatgggtggttcggccttcgaccttggccgttttatgcatcataacattaataatctcggagatcccttccaaagcggcggctacaaaccgaacacgaaggttgttgagcgtgccgtcctggactattatgcggcgttatggcacgcggatggtccatacgatgccgccgatccgcagtcctattggggctacgtgttgtcgatgggtagcaccgaagggaacatgtatgcactgtggaatgctcgcgactaccttagtggcaaagcattaatccagcctcctactggtccatgtggagcggcgcgttacgtaaaagctccggcagaaccgggtaacccgaatgcctatcgcccagtggcgttctattccgaagatacgcactacagctttgcgaaagcggtccatgtactcggcgtggagacctttcatgccgttggcaccgaacaatatccggatgaatgccccttgccggctgctgcaggaggtgcagcagccggcgccgcctctggtcctcgtgagtggcccgctgaagtgccctcacacagtggcccaagcggtcattcttgggatggaacgggcgagattgacgtcgaagcccttgctgttctcgtggaattctttgcagccaagggccacccgatctttgtctcgttaaacttgggctccacattcaaaggtgctcatgacgacgtacgcggtgtgtgtgaacgtcttctcccgatttttgagaaatacggtttaatccagggcgaagttgcctatggaaaagatccgcgcaccggcgaaccgttggttgatttacgtcgtcgcttctggattcacgtggatggcgcactcggtgcaggctatgccccgtttttgcgcatggctgctgacgatccagcaggttttggatgggagccggatactcgtcttcccgaattcgactttggcatcaccttacctacgcgcgaattcggtgacctcgatatggtgtcaagcattgccatgagcggtcataagtggcctggtgcaccatggccatgcggcatctacatgaccaaagtcaaatatcagattgcacctccgtctcaacccgattacattggcgcccccgatacgacttttgcaggatcgcgtaacggcttctcccctcttatcttgtgggaccatttaagtcgccacagctatcaggatcaagtagatcgtattcgtcgtgcccaggacttggctgcttacctcgaacaacaacttcgtttgttggagctcgagaaagatgtcgaattatggccagcacgcacaccaggtgccatcaccgttcgctttcgcaaacctagtcccgaacttgtagccaagtggagcctttcatcacaggatgtgttaaccgttccaggcgacgaatctacgcgccgctcctatgtgcatgtgttcctcatgtcgtcggttgatcgtgccaaattagacgcattgttggctgatctcggtaatgatcccgtgattttacgccgcccataatag

SEQ ID NO: 6 - protein, 591 aa, synthetic construct
  REGION 1..591: note = Wild Type Amino Acid Decarboxylase from Kitasatospora sp. MBT63
MRRTDTLTLDLGHGHGAPARSDARMSPLGVPAQASAPSPAPGGPLAPAEEPALCDFLLPADGLDDEQRLRALDTMDAYLTGKRRYLLGYQATQEMGGSAFDLGRFMHHNINNLGDPFQSGGYKPNTKVVERAVLDYYAALWHADGPYDAADPQSYWGYVLSMGSTEGNMYALWNARDYLSGKALIQPPTGPCGAARYVKAPAEPGNPNAYRPVAFYSEDTHYSFAKAVHVLGVETFHAVGTEQYPDECPLPAAAGGAAAGAASGPREWPAEVPSHSGPSGHSWDGTGEIDVEALAVLVEFFAAKGHPIFVSLNLGSTFKGAHDDVRGVCERLLPIFEKYGLIQGEVAYGKDPRTGEPLVDLRRRFWIHVDGALGAGYAPFLRMAADDPAGFGWEPDTRLPEFDFGITLPTREFGDLDMVSSIAMSGHKWPGAPWPCGIYMTKVKYQIAPPSQPDYIGAPDTTFAGSRNGFSPLILWDHLSRHSYQDQVDRIRRAQDLAAYLEQQLRLLELEKDVELWPARTPGAITVRFRKPSPELVAKWSLSSQDVLTVPGDESTRRSYVHVFLMSSVDRAKLDALLADLGNDPVILRRP

SEQ ID NO: 7 - DNA, 1665 bp, synthetic construct
  misc_feature 1..1665: note = Wild Type Amino Acid Decarboxylase from Kitasatospora sp. MMS16-BH015
  source 1..1665: mol_type = other DNA
atgagtccgtttgaaaccatgaatcctgcggcggatcaggagctgccaccattagccttggctggccatcgtcttccgcaaccgccggcagaagaacctcaggtggccgagtatgcaattccagttggtggtttagaccgcgaacaacgtctgcgcgctctcgatcgcatcgatacgtaccttgcacacaaacgtcagcatttgttgggctatcaggctaaccaggaactcgatggatgcgcgtctgacttaggtcgtttcatgcgccacaacattaataatttaggcgatccctttcgtagcggcgggtacaaacccaacactaaggccgtcgaacatgcagtactcgactattatgccgatctttggcgcgcgaaaggtcctcactcgccagaggatcccgaatcctactgggggtatgcgctttcaatgggaagcaccgaaggcaacatgtacgcgttgtggaatgcccgcgactatctcagcggtaagcctttaatccgtcctacagcatctagtggctcaggagcagtggtgacgccaaactcgcgtcgcccagttgccttctacagcgaggacacccattattcctttgcgaaagctgtacgtgttttgggtgtcgaaaccttccacgatattggcgtggaaaactatccaggtcagtgtccactccctggcagtggtggtgtgtggccccttgaagttcccagtgttcctggtccctcgggattatcttgggatggcacgggcgaaatcagcgtggatgcgctcgaattgttggtcgagttctttgcggctaaaggccatcccgtctttgtgtcccttaatttaggcagcacctttaaaggtgcccatgacgacgtacgcgcagtttgcgaacgtttgctccccattttcgaacgctacggcatggtggagtcagaggtcgtacgcggtcgtgatcaacgtagcggcgagcttcttactgatcgccgccgtcgcttctggatccacgtggacggagccttaggtgcggcctacctcccttttttacgtttggcgcaggaatccccagaaacatatggttggacaccagctgcaccagcgcctgagtttgattttggcttgcgcttaccaaccgctggccatggcgaagttgatctcgtcagctcgattgccatgtctggacacaaatggcctggtgttccttggccctgtggcatctacatgacgaaagtgaagtatcaagtgagtcctccctctcagccagactataccggtgcacctgatactactttcgcgggctcacgtaacggcttttcgccacttgtactctgggatcatttagcccgccatagccacgccgaccaagtcgatcgtattcgccgctcccaggaattggcggcataccttgaaagccgtttaaccgcattggaacgtacccatggtcttaccttatggcctgctcgcacaccaggagctttaaccgttcgtttccgtaaacctagtcccgaactcgtgactaaatggtcgttgtcagcccaggatgttctcacgactccaggtgaagaagcaacccgccgctcctatgtgcacgtcttcttaatgccaagcgtaacccgtgagaaattggatgcgctccttgatgacctcgtgaatgaccccgtgattacaggctcctaatag

SEQ ID NO: 8 - protein, 553 aa, synthetic construct
  REGION 1..553: note = Wild Type Amino Acid Decarboxylase from Kitasatospora sp. MMS16-BH015
MSPFETMNPAADQELPPLALAGHRLPQPPAEEPQVAEYAIPVGGLDREQRLRALDRIDTYLAHKRQHLLGYQANQELDGCASDLGRFMRHNINNLGDPFRSGGYKPNTKAVEHAVLDYYADLWRAKGPHSPEDPESYWGYALSMGSTEGNMYALWNARDYLSGKPLIRPTASSGSGAVVTPNSRRPVAFYSEDTHYSFAKAVRVLGVETFHDIGVENYPGQCPLPGSGGVWPLEVPSVPGPSGLSWDGTGEISVDALELLVEFFAAKGHPVFVSLNLGSTFKGAHDDVRAVCERLLPIFERYGMVESEVVRGRDQRSGELLTDRRRRFWIHVDGALGAAYLPFLRLAQESPETYGWTPAAPAPEFDFGLRLPTAGHGEVDLVSSIAMSGHKWPGVPWPCGIYMTKVKYQVSPPSQPDYTGAPDTTFAGSRNGFSPLVLWDHLARHSHADQVDRIRRSQELAAYLESRLTALERTHGLTLWPARTPGALTVRFRKPSPELVTKWSLSAQDVLTTPGEEATRRSYVHVFLMPSVTREKLDALLDDLVNDPVITGS

SEQ ID NO: 9 - DNA, 1620 bp, synthetic construct
  misc_feature 1..1620: note = Wild Type Amino Acid Decarboxylase from Streptomyces sp. NRRL F-6131
  source 1..1620: mol_type = other DNA
atgagtccaaccaccgcgcgtgctgcagttgcacgcgcggcgctggatggcgccttagaccgtgctgtcgtggatcgcgccgtagtagatcgtgccgtggttgaaggtgcagctgttcctggaccggtccatgttgacgcagagccggaaggcgccgattttgcaattccggccgaaggtctgacggatggcgaacgtttacgcgcccttgaccgcatggatgggtatctgactcgtaaacgtcgtcacctcgtgggttaccaggctacacaagagctggctggtagcgccctggatttagcacgcttcatgctgtccaacatcaataatttgggcgacccctttcagtctggcgggtataaaccgaacacgaaggtcgtcgaacgcgccgtactggattactacgcccgcctttggcatgcaggtccatcgtatgaccctgcagatccggagtcatattggggctatatgctgagcatgggaagtaccgaaggcaacatgtacgccctctggaatgctcgcgactatttaactcgtccaggtgcaccgcgtccggttgccttctacagcgaagatacccactatagctttgctaaagccgttcgcgtactgggtgtcgatacgttccatgcagtaggaaccgccgattaccccgatgaatgccctcttggtggcgagtggccggctgaagttccgtctcagccaggcccttcaggtttgtcgtgggacggcagtggcgcagtcgacttagatgcactggccgccctggtcgagttctttgctgctaaaggtcacccggtctttgttaactttaatttgggctccaccttcaaaggagcccatgatgatgtacgtggtgcatgtgaacgcctcctcccgatttttgaacgccatggcttattaccacgtgcaggttcagatgctcgtcgtggcttctggatccacgttgatggtgcattgggtgccggttatgccccctttcttcgcatggcttctgcagatcctgccgcatttggctgggaaccggaggccgaactcccggaattcgactttggccttacgttggctacacgcgaaagcggcgacgtagatccagttgcatcgattgccatgagcggacataaatgggctggtgtaccctggccatgcggcgtcttcatgaccaagactaaatatcaacttgaacctcctacgcagcccgagtacattggtgccccagactccacctttgccggaagtcgtaacggctttagcccattggttttatgggatcacttatctcgcctctcgcatcgtgatcaagtcgatcgtatccgccgctcccaggaactcgctgcatatcttgagcgtcgtttgcgcgaagttgaacgcgaaacaggcgcagaattgtggccagcacgcacgcctggtgctatcaccgtacgtttccgtaaaccttcagccggattggttgccaagtggagccttagttcggagaacgttttaacaactcccggtgatcctgccggcttacgtggctacgtacacgtctttctcatgccatcagtcgaccgtgctaaattagacgctcttctcgacgatttggctcgtgatcccgtcattcttggtcgcgcttaatag

SEQ ID NO: 10 - protein, 538 aa, synthetic construct
  REGION 1..538: note = Wild Type Amino Acid Decarboxylase from Streptomyces sp. NRRL F-6131
MSPTTARAAVARAALDGALDRAVVDRAVVDRAVVEGAAVPGPVHVDAEPEGADFAIPAEGLTDGERLRALDRMDGYLTRKRRHLVGYQATQELAGSALDLARFMLSNINNLGDPFQSGGYKPNTKVVERAVLDYYARLWHAGPSYDPADPESYWGYMLSMGSTEGNMYALWNARDYLTRPGAPRPVAFYSEDTHYSFAKAVRVLGVDTFHAVGTADYPDECPLGGEWPAEVPSQPGPSGLSWDGSGAVDLDALAALVEFFAAKGHPVFVNFNLGSTFKGAHDDVRGACERLLPIFERHGLLPRAGSDARRGFWIHVDGALGAGYAPFLRMASADPAAFGWEPEAELPEFDFGLTLATRESGDVDPVASIAMSGHKWAGVPWPCGVFMTKTKYQLEPPTQPEYIGAPDSTFAGSRNGFSPLVLWDHLSRLSHRDQVDRIRRSQELAAYLERRLREVERETGAELWPARTPGAITVRFRKPSAGLVAKWSLSSENVLTTPGDPAGLRGYVHVFLMPSVDRAKLDALLDDLARDPVILGRA

SEQ ID NO: 11 - DNA, 1224 bp, synthetic construct
  misc_feature 1..1224: note = Wild Type Leucine Decarboxylase from Planctomycetaceae bacterium
  source 1..1224: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtaatag

SEQ ID NO: 12 - protein, 406 aa, synthetic construct
  REGION 1..406: note = Wild Type Leucine Decarboxylase from Planctomycetaceae bacterium
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 13 - DNA, 1185 bp, synthetic construct
  misc_feature 1..1185: note = Wild Type Amino Acid Decarboxylase from Larkinella arboricola
  source 1..1185: mol_type = other DNA
atgaccgtgaaagaagttgaacgtctgcagcgctataaagatctgttagcggaacgtagcagcaacgccattggttacccgtttgcactcgacttcgatttttcggagttgcatacgctgttccaatatcacatcaataatgtgggcgacccatacatcgagtccaactacgatgtcaactctcatagtatggaacgcgaggtcgtagaattctttgctgatctgtttcgtgcgccgaagcacaatcgctgggggtatgttacttcaggaggatcggaaggtaacctttatggtctgtatgtggcccgcgaactgtatcctgaagcggtgatttactactccgcagctacccattacagcattagcaaatctatccgtttgttgaatatgccgtcgtgcatgattcgtattcagcccaacggtgagatggactataaagatctggaagaaagtatcaaacgctattcaaatcgtccggccatcgttgttgcgaacatcgggacgacaatgaccgaagcaaaggatgatgtaccaaccattcgctccgtgcttcagaaagcggcggtgaaaagccactacatccattgtgacgctgccttaagtgggtcttatctggcagtcctcgaggaggaaccgcaatttgacttcgccaacggtgtcgatagcattgcatgctcaggacacaagttcattggttcgccttttccgtgtggtgtagtggtgatcaaagatcagtacaaagaacgcgtttctaaacccgtcagctatattgggtcctttgacagtactattgctggaagccgtaatggtcattcgccggttttcatgtggtatgccatcaaacagcaggggcgcgaaggtctgctgcgtcgtgcgttagagtgcctgtctctggcggaatacacacaacgccgcctccaggaacatggtattgcggcgtggcgtaacgaaaaggcaatcacggtggtgtttccaaaaccgtccgcctcaatctgtcgcaaatggcaacttgccaccaatgcaggacaggctcacctgatttgcatgccagggattagccaacagcgcatcgatgattttattgaggacctgctgaaagaaaccagtttgattgcgcgtgaaccgacgcatagccgtgtcttcgttaaacctggtgattcgatcatgattacccagctgtaatag

SEQ ID NO: 14 - protein, 393 aa, synthetic construct
  REGION 1..393: note = Wild Type Amino Acid Decarboxylase from Larkinella arboricola
MTVKEVERLQRYKDLLAERSSNAIGYPFALDFDFSELHTLFQYHINNVGDPYIESNYDVNSHSMEREVVEFFADLFRAPKHNRWGYVTSGGSEGNLYGLYVARELYPEAVIYYSAATHYSISKSIRLLNMPSCMIRIQPNGEMDYKDLEESIKRYSNRPAIVVANIGTTMTEAKDDVPTIRSVLQKAAVKSHYIHCDAALSGSYLAVLEEEPQFDFANGVDSIACSGHKFIGSPFPCGVVVIKDQYKERVSKPVSYIGSFDSTIAGSRNGHSPVFMWYAIKQQGREGLLRRALECLSLAEYTQRRLQEHGIAAWRNEKAITVVFPKPSASICRKWQLATNAGQAHLICMPGISQQRIDDFIEDLLKETSLIAREPTHSRVFVKPGDSIMITQL

SEQ ID NO: 15 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcctggggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatgtcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 16 - protein, 406 aa, synthetic construct
  REGION 1..406: note = Variant of Leucine Decarboxylase
MGNLKFPDGALSPHDRRRLEDVYQYVREQCDTFLGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 17 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 18 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 19 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcctggggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 20 - protein, 406 aa, synthetic construct
  REGION 1..406: note = Variant of Leucine Decarboxylase
MGNLKFPDGALSPHDRRRLEDVYQYVREQCDTFLGYPVNMHFDYTPLLPFLAYPVNNVGDPFAASSYRVHTREIEREVLAWFAELMHIAPEEYWGYVTNGGSEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 21 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtgttgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 22 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSVEYIGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 23 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 24 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 25 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 26 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 27 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcctggggtatccgtgcaacatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 28 - protein, 406 aa, synthetic construct
  REGION 1..406: note = Variant of Leucine Decarboxylase
MGNLKFPDGALSPHDRRRLEDVYQYVREQCDTFLGYPCNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIATEGDRAHIVLMPSTTLQHVDELIADIAAANKAAAAPSDTQKPAAKKRPTPAGAPQRTT

SEQ ID NO: 29 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 30 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 31 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatatcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 32 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYIGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 33 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 34 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 35 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 36 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 37 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 38 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANKAAAAPSDTQKPAAKKRPTPAGAPQRTT

SEQ ID NO: 39 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcctggggtatccggtaaacatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 40 - protein, 406 aa, synthetic construct
  REGION 1..406: note = Variant of Leucine Decarboxylase
MGNLKFPDGALSPTDRRRLEDVYQYVREQCDTFLGYPVNMHFDYTPLLPFLAYPVNNVGDPFAASSYRVHTREIEREVLAWFAELMHIAPEEYWGYVTNGGSEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 41 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 42 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYIGTLDTTISGSRNGITPLFLWYAVKQAGRDGFKRRVAACLDNARYTVEQFKRIGVEARRNPCAITVVFPKPPQSVLHKWQIAVEGDRAHIILMPSTTLQHVDELIADIAAANKAAAAPSDTQKPAAKKRPTPAGAPQRTT

SEQ ID NO: 43 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 44 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 45 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattatcttaatgccaagtaccaccctccagcatgtcgatgaattgatcgctgacattgcagccgccaataaagcggctgcagcaccgagcgatacgcagaaacctgccgccaagaaacgcccgacaccggctggtgcaccgcaacgtactacgtag

SEQ ID NO: 46 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVEGDRAHIILMPSTTLQHVDELIADIAAANKAAAAPSDTQKPAAKKRPTPAGAPQRTT

SEQ ID NO: 47 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcctggggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 48 - protein, 406 aa, synthetic construct
  REGION 1..406: note = Variant of Leucine Decarboxylase
MGNLKFPDGALSPHDRRRLEDVYQYVREQCDTFLGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 49 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 50 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 51 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 52 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 53 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcctggggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 54 - protein, 406 aa, synthetic construct
  REGION 1..406: note = Variant of Leucine Decarboxylase
MGNLKFPDGALSPHDRRRLEDVYQYVREQCDTFLGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 55 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 56 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVEGDRAHIILMPSTTLQHVDELIADIAAANKAAAAPSDTQKPAAKKRPTPAGAPQRTT

SEQ ID NO: 57 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 58 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTITGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 59 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 60 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIVLMPSTTLQHVDELIADIAAANKAAAAPSDTQKPAAKKRPTPAGAPQRTT

SEQ ID NO: 61 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 62 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 63 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 64 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 65 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatatcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 66 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYIGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 67 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcctggggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 68 - protein, 406 aa, synthetic construct
  REGION 1..406: note = Variant of Leucine Decarboxylase
MGNLKFPDGALSPHDRRRLEDVYQYVREQCDTFLGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIATEGDRAHIVLMPSTTLQHVDELIADIAAANKAAAAPSDTQKPAAKKRPTPAGAPQRTT

SEQ ID NO: 69 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcctggggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 70 - protein, 406 aa, synthetic construct
  REGION 1..406: note = Variant of Leucine Decarboxylase
MGNLKFPDGALSPHDRRRLEDVYQYVREQCDTFLGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTISGSRNGITPLFLWYAVKQAGRDGFKRRVAACLDNARYTVEQFKRIGVEARRNPCAITVVFPKPPQSVLHKWQIATNGDRAHIVLMPSTTLQHVDELIADIAAANKAAAAPSDTQKPAAKKRPTPAGAPQRTT

SEQ ID NO: 71 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatgtcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 72 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 73 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcctggggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 74 - protein, 406 aa, synthetic construct
  REGION 1..406: note = Variant of Leucine Decarboxylase
MGNLKFPDGALSPHDRRRLEDVYQYVREQCDTFLGYPCNMHFDYTPLLPFLAYPVNNVGDPFAASSYRVHTREIEREVLAWFAELMHIAPEEYWGYVTNGGSEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 75 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 76 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVEGDRAHIVLMPSTTLQHVDELIADIAAANKAAAAPSDTQKPAAKKRPTPAGAPQRTT

SEQ ID NO: 77 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattacgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 78 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIATEGDRAHIVLMPSTTLQHVDELIADIAAANKAAAAPSDTQKPAAKKRPTPAGAPQRTT

SEQ ID NO: 79 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 80 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYIGTLDTTISGSRNGITPLFLWYAVKQAGRDGFKRRVAACLDNARYTVEQFKRIGVEARRNPCAITVVFPKPPQSVLHKWQIAVEGDRAHIILMPSTTLQHVDELIADIAAANKAAAAPSDTQKPAAKKRPTPAGAPQRTT

SEQ ID NO: 81 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaacggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 82 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 83 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtgttgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtagagggcgaccgcgcgcatattatcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 84 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGTEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSVEYIGTLDTTISGSRNGITPLFLWYAVKQAGRDGFKRRVAACLDNARYTVEQFKRIGVEARRNPCAITVVFPKPPQSVLHKWQIAVEGDRAHIILMPSTTLQHVDELIADIAAANKAAAAPSDTQKPAAKKRPTPAGAPQRTT

SEQ ID NO: 85 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccggtaaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtgttgaatatgtcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 86 - protein, 406 aa, synthetic construct
  REGION 1..406: note = Variant of Leucine Decarboxylase
MGNLKFPDGALSPHDRRRLEDVYQYVREQCDTFIGYPVNMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSVEYVGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 87 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagacacgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagtaaatggcgaccgcgcgcatattgtcttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 88 - protein, 406 aa, synthetic construct
  REGION 1..406: note = Variant of Leucine Decarboxylase
MGNLKFPDGALSPHDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIAVNGDRAHIVLMPSTTLQHVDELIADIAAANKAAAAPSDTQKPAAKKRPTPAGAPQRTT

SEQ ID NO: 89 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaagatccgacaccggctggtgcaccgcaacgtactacgtag

SEQ ID NO: 90 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKDPTPAGAPQRTT

SEQ ID NO: 91 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccggcgccggctggtgcaccgcaacgtactacgtag

SEQ ID NO: 92 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPAPAGAPQRTT

SEQ ID NO: 93 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgttctatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 94 - protein, 406 aa, synthetic construct
  REGION 1..406: note = Variant of Leucine Decarboxylase
MGNLKFPDGALSPHDRRRLEDVYQYVREQCDTFIGYPCSMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 95 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacataggctggtgcaccgcaacgtactacgtag

SEQ ID NO: 96 - protein, 397 aa, synthetic construct
  REGION 1..397: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPT

SEQ ID NO: 97 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcaggggcccgccgccaagaaacgcccgacaccggctggtgcaccgcaacgtactacgtag

SEQ ID NO: 98 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQGPAAKKRPTPAGAPQRTT

SEQ ID NO: 99 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagcagcccgccgccaagaaacgcccgacaccggctggtgcaccgcaacgtactacgtag

SEQ ID NO: 100 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQQPAAKKRPTPAGAPQRTT

SEQ ID NO: 101 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctctttttccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 102 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLFPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 103 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtcttacgtag

SEQ ID NO: 104 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRLT

SEQ ID NO: 105 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaaccctaggccaagaaacgcccgacaccggctggtgcaccgcaacgtactacgtag

SEQ ID NO: 106 - protein, 390 aa, synthetic construct
  REGION 1..390: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKP

SEQ ID NO: 107 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctggagaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 108 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLEKWQIAVNGDRAHIILMPSTTLQHVDELIADIAAANKAAAAPSDTQKPAAKKRPTPAGAPQRTT

SEQ ID NO: 109 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccacgaaacgcccgacaccggctggtgcaccgcaacgtactacgtag

SEQ ID NO: 110 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAATKRPTPAGAPQRTT

SEQ ID NO: 111 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcgctcgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 112 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFARRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 113 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgattgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 114 - protein, 406 aa, synthetic construct
  REGION 1..406: note = Variant of Leucine Decarboxylase
MGNLKFPDGALSPIDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 115 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccttgcagcatgtcgatgaattgatcgctgacattgcagccgccaataaagcggctgcagcaccgagcgatacgcagaaacccgccgccaaggaacgcccgacaccggctggtgcaccgcaacgtactacgtag

SEQ ID NO: 116 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKERPTPAGAPQRTT

SEQ ID NO: 117 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgaggccaagaaacgcccgacaccggctggtgcaccgcaacgtactacgtag

SEQ ID NO: 118 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPEAKKRPTPAGAPQRTT

SEQ ID NO: 119 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaggctggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 120 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKRLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 121 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaagggtatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 122 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKGYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 123 - DNA, 1221 bp, synthetic construct
  misc_feature 1..1221: note = Variant of Leucine Decarboxylase
  source 1..1221: mol_type = other DNA
atgggtaatctgatgtttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 124 - protein, 406 aa, synthetic construct
  REGION 1..406: note = Variant of Leucine Decarboxylase
MGNLMFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 125 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaaggatctggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 126 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKDLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 127 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaaaagccgacaccggctggtgcaccgcaacgtactacgtag

SEQ ID NO: 128 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKKPTPAGAPQRTT

SEQ ID NO: 129 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctggctaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 130 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLAKWQIAVNGDRAHIILMPSTTLQHVDELIADIAAANKAAAAPSDTQKPAAKKRPTPAGAPQRTT

SEQ ID NO: 131 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 132 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEAMRNPCAITVVFPKPPQSVLHKWQIAVNGDRAHIILMPSTTLQHVDELIADIAAANKAAAAPSDTQKPAAKKRPTPAGAPQRTT

SEQ ID NO: 133 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgacgaggcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 134 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDEAHIILMPSTTLQHVDELIADIAAANKAAAAPSDTQKPAAKKRPTPAGAPQRTT

SEQ ID NO: 135 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccaggcagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 136 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTRQHVDELIADIAAANKAAAAPSDTQKPAAKKRPTPAGAPQRTT

SEQ ID NO: 137 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcaggagcccgccgccaagaaacgcccgacaccggctggtgcaccgcaacgtactacgtag

SEQ ID NO: 138 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQEPAAKKRPTPAGAPQRTT

SEQ ID NO: 139 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttagtggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 140 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVSGDRAHIILMPSTTLQHVDELIADIAAANKAAAAPSDTQKPAAKKRPTPAGAPQRTT

SEQ ID NO: 141 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgctgtcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 142 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 143 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaagctccgacaccggctggtgcaccgcaacgtactacgtag

SEQ ID NO: 144 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKAPTPAGAPQRTT

SEQ ID NO: 145 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaaccttatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 146 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKPYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 147 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcgcgcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 148 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 149 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagcctcccgccgccaagaaacgcccgacaccggctggtgcaccgcaacgtactacgtag

SEQ ID NO: 150 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQPPAAKKRPTPAGAPQRTT

SEQ ID NO: 151 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaatgatgcggctgcagcaccgagcgatacgcagaaacccgccgccaagaaacgcccgacaccggctggtgcaccgcaacgtactacgtag

SEQ ID NO: 152 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANDAAAAPSDTQKPAAKKRPTPAGAPQRTT

SEQ ID NO: 153 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaaaattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 154 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKNYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 155 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctcgagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 156 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLEHVDELIADIAAANKAAAAPSDTQKPAAKKRPTPAGAPQRTT

SEQ ID NO: 157 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggattcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 158 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPDSVLHKWQIAVNGDRAHIILMPSTTLQHVDELIADIAAANKAAAAPSDTQKPAAKKRPTPAGAPQRTT

SEQ ID NO: 159 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtcatacgtag

SEQ ID NO: 160 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRHT

SEQ ID NO: 161 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggatgcagcaccgagcgatacgcagaaacccgccgccaagaaacgcccgacaccggctggtgcaccgcaacgtactacgtag

SEQ ID NO: 162 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKADAAPSDTQKPAAKKRPTPAGAPQRTT

SEQ ID NO: 163 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatatttgtttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 164 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHICLMPSTTLQHVDELIADIAAANKAAAAPSDTQKPAAKKRPTPAGAPQRTT

SEQ ID NO: 165 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtgagacgtag

SEQ ID NO: 166 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRET

SEQ ID NO: 167 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtgatacgtag

SEQ ID NO: 168 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRDT

SEQ ID NO: 169 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgactgggcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 170 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDWAHIILMPSTTLQHVDELIADIAAANKAAAAPSDTQKPAAKKRPTPAGAPQRTT

SEQ ID NO: 171 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacttgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgactcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 172 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEATRNPCAITVVFPKPPQSVLHKWQIAVNGDRAHIILMPSTTLQHVDELIADIAAANKAAAAPSDTQKPAAKKRPTPAGAPQRTT

SEQ ID NO: 173 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggaggcagcaccgagcgatacgcagaaacccgccgccaagaaacgcccgacaccggctggtgcaccgcaacgtactacgtag

SEQ ID NO: 174 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAEAAPSDTQKPAAKKRPTPAGAPQRTT

SEQ ID NO: 175 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctggggatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 176 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLGMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 177 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcgttcgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 178 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFVRRVAACLDNARYTVEQFKRIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 179 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaatccggcggctgcagcaccgagcgatacgcagaaacccgccgccaagaaacgcccgacaccggctggtgcaccgcaacgtactacgtag

SEQ ID NO: 180 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANPAAAAPSDTQKPAAKKRPTPAGAPQRTT

SEQ ID NO: 181 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 182 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPASVLHKWQIAVNGDRAHIILMPSTTLQHVDELIADIAAANKAAAAPSDTQKPAAKKRPTPAGAPQRTT

SEQ ID NO: 183 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 184 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEASRNPCAITVVFPKPPQSVLHKWQIAVNGDRAHIILMPSTTLQHVDELIADIAAANKAAAAPSDTQKPAAKKRPTPAGAPQRTT

SEQ ID NO: 185 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgacgatgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 186 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDDAHIILMPSTTLQHVDELIADIAAANKAAAAPSDTQKPAAKKRPTPAGAPQRTT

SEQ ID NO: 187 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccaagcagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 188 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTKQHVDELIADIAAANKAAAAPSDTQKPAAKKRPTPAGAPQRTT

SEQ ID NO: 189 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaaggtccgacaccggctggtgcaccgcaacgtactacgtag

SEQ ID NO: 190 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKGPTPAGAPQRTT

SEQ ID NO: 191 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgacagtgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 192 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDSAHIILMPSTTLQHVDELIADIAAANKAAAAPSDTQKPAAKKRPTPAGAPQRTT

SEQ ID NO: 193 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaaagtccgacaccggctggtgcaccgcaacgtactacgtag

SEQ ID NO: 194 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPSDTQKPAAKKSPTPAGAPQRTT

SEQ ID NO: 195 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattatgttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 196 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIMLMPSTTLQHVDELIADIAAANKAAAAPSDTQKPAAKKRPTPAGAPQRTT

SEQ ID NO: 197 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagctagacgcagaaacccgccgccaagaaacgcccgacaccggctggtgcaccgcaacgtactacgtag

SEQ ID NO: 198 - protein, 385 aa, synthetic construct
  REGION 1..385: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDRAHIILMPSTTLQHVDELIADIAAANKAAAAPS

SEQ ID NO: 199 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgacaatgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 200 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDNAHIILMPSTTLQHVDELIADIAAANKAAAAPSDTQKPAAKKRPTPAGAPQRTT

SEQ ID NO: 201 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcagttaacggcgaccttgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 202 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKRIGVEARRNPCAITVVFPKPPQSVLHKWQIAVNGDLAHIILMPSTTLQHVDELIADIAAANKAAAAPSDTQKPAAKKRPTPAGAPQRTT

SEQ ID NO: 203 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgcatgaccgccgccgtctggaagatgtgtatcagtacgttcgtgagcaatgcgacaccttcattgggtatccgtgtacgatgcactttgattacacacctcttttaccgttcctggcctatcccgtcaacaacgtaggcgatccgtttgctgcatccagttatcgcgtgcatacccgtgaaatcgaacgcgaggttctggcgtggttcgccgaactcatgcacattgcaccagaagaatactggggttatgtgactaatggaggaaccgagggcaacctgtacggtttgtttttagcgcgtgaacgctttcctacgggcgtcgcctactattcggaagacacccattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgattccttgcggcatcgttttgacacgcaaacattatgtggagcgtattgctcgcagtatcgaatatgtcggtaccctggacactacgattaccggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgcgtcgtaatccatgcgccattaccgttgtgttcccgaaacctccgcagtcagtgctgcacaagtggcaaatcgcagttaacggcgaccgcgcgcatattattttaatgccaagtaccaccctccagcatgtcgatgaattgatcgctgacattgcagccgccaataaagcggctgcagcaccgagcgatacgcagaaacccgccgccaagaaacgcccgacaccggctggtgcaccgcaacgtactacgtag

SEQ ID NO: 204 - protein, 406 aa, synthetic construct
  REGION 1..406: note = Variant of Leucine Decarboxylase
MGNLKFPDGALSPHDRRRLEDVYQYVREQCDTFIGYPCTMHFDYTPLLPFLAYPVNNVGDPFAASSYRVHTREIEREVLAWFAELMHIAPEEYWGYVTNGGTEGNLYGLFLARERFPTGVAYYSEDTHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPIPCGIVLTRKHYVERIARSIEYVGTLDTTITGSRNGITPLFLWYAVKQAGRDGFKRRVAACLDNARYTVEQFKKIGVEARRNPCAITVVFPKPPQSVLHKWQIAVNGDRAHIILMPSTTLQHVDELIADIAAANKAAAAPSDTQKPAAKKRPTPAGAPQRTT

SEQ ID NO: 205 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctgcacaagtggcaaatcgcaaccgagggcgaccgcgcgcatatttgcttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 206 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLHKWQIATEGDRAHICLMPSTTKQHVDELIADIAAANKAAAAPSDTQKPAAKKRPTPAGAPQRTT

SEQ ID NO: 207 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcacaagtggcaaatcgcaaccgagggcgactgggcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 208 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDWAHICLMPSTTRQHVDELIADIAAANKAAAAPSDTQKPAAKKRPTPAGAPQRTT

SEQ ID NO: 209 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgagtcgtaatccatgcgccattaccgttgtgttcccgaaacctccgcagtcagtgctgcataagtggcaaatcgcaaccgagggcgaccgcgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 210 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEASRNPCAITVVFPKPPQSVLHKWQIATEGDRAHIVLMPSTTRQHVDELIADIAAANKAAAAPSDTQKPAAKKRPTPAGAPQRTT

SEQ ID NO: 211 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgcgtcgtaatccatgcgccattaccgttgtgttcccgaaacctccgcagtcagtgctggaaaagtggcaaatcgcaaccgagggcgaccgcgcgcatattatgttaatgccaagtaccaccctgcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 212 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEARRNPCAITVVFPKPPQSVLEKWQIATEGDRAHIMLMPSTTLQHVDELIADIAAANKAAAAPSDTQKPAAKKRPTPAGAPQRTT

SEQ ID NO: 213 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgaatcgtaatccatgcgccattaccgttgtgttcccgaaacctccgcagtcagtgctgcataagtggcaaatcgcaaccgagggcgactgggcgcatatttgcttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 214 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEANRNPCAITVVFPKPPQSVLHKWQIATEGDWAHICLMPSTTKQHVDELIADIAAANKAAAAPSDTQKPAAKKRPTPAGAPQRTT

SEQ ID NO: 215 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttcccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcacaagtggcaaatcgcaaccgagggcgaccgcgcgcatattatgttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 216 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIMLMPSTTKQHVDELIADIAAANKAAAAPSDTQKPAAKKRPTPAGAPQRTT

SEQ ID NO: 217 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctgcataagtggcaaatcgcaaccgagggcgacaatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 218 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLHKWQIATEGDNAHICLMPSTTRQHVDELIADIAAANKAAAAPSDTQKPAAKKRPTPAGAPQRTT

SEQ ID NO: 219 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcataagtggcaaatcgcaaccgagggcgactgggcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 220 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDWAHICLMPSTTRQHVDELIADIAAANKAAAAPSDTQKPAAKKRPTPAGAPQRTT

SEQ ID NO: 221 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgacgatgcgcatattgtgttaatgccaagtaccaccctgcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 222 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDDAHIVLMPSTTLQHVDELIADIAAANKAAAAPSDTQKPAAKKRPTPAGAPQRTT

SEQ ID NO: 223 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctggaaaagtggcaaatcgcaaccgagggcgacgatgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 224 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHIVLMPSTTRQHVDELIADIAAANKAAAAPSDTQKPAAKKRPTPAGAPQRTT

SEQ ID NO: 225 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgcgtcgtaatccatgcgccattaccgttgtgttcccgaaacctccgcagtcagtgctggaaaagtggcaaatcgcaaccgagggcgaccgcgcgcatatttgcttaatgccaagtaccaccctgcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 226 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEARRNPCAITVVFPKPPQSVLEKWQIATEGDRAHICLMPSTTLQHVDELIADIAAANKAAAAPSDTQKPAAKKRPTPAGAPQRTT

SEQ ID NO: 227 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcacaagtggcaaatcgcaaccgagggcgaccgcgcgcatattattttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 228 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTRQHVDELIADIAAANKAAAAPSDTQKPAAKKRPTPAGAPQRTT

SEQ ID NO: 229 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttcccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctggaaaagtggcaaatcgcaaccgagggcgaccgcgcgcatattatcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 230 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDRAHIILMPSTTRQHVDELIADIAAANKAAAAPSDTQKPAAKKRPTPAGAPQRTT

SEQ ID NO: 231 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgagtcgtaatccatgcgccattaccgttgtgttcccgaaacctccgcagtcagtgctgcacaagtggcaaatcgcaaccgagggcgaccgcgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 232 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEASRNPCAITVVFPKPPQSVLHKWQIATEGDRAHIVLMPSTTRQHVDELIADIAAANKAAAAPSDTQKPAAKKRPTPAGAPQRTT

SEQ ID NO: 233 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 234 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 235 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttcccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctggaaaagtggcaaatcgcaaccgagggcgacgaggcgcatatttgcttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 236 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDEAHICLMPSTTKQHVDELIADIAAANKAAAAPSDTQKPAAKKRPTPAGAPQRTT

SEQ ID NO: 237 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctgcacaagtggcaaatcgcaaccgagggcgaccgcgcgcatattatgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 238 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLHKWQIATEGDRAHIMLMPSTTRQHVDELIADIAAANKAAAAPSDTQKPAAKKRPTPAGAPQRTT

SEQ ID NO: 239 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgatgcgtaatccatgcgccattaccgttgtgttcccgaaacctccgcagtcagtgctggaaaagtggcaaatcgcaaccgagggcgacgaggcgcatatttgcttaatgccaagtaccaccctccagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 240 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEAMRNPCAITVVFPKPPQSVLEKWQIATEGDEAHICLMPSTTLQHVDELIADIAAANKAAAAPSDTQKPAAKKRPTPAGAPQRTT

SEQ ID NO: 241 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcacaagtggcaaatcgcaaccgagggcgacgatgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 242 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDDAHIVLMPSTTRQHVDELIADIAAANKAAAAPSDTQKPAAKKRPTPAGAPQRTT

SEQ ID NO: 243 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatattgtgttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 244 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHIVLMPSTTKQHVDELIADIAAANKAAAAPSDTQKPAAKKRPTPAGAPQRTT

SEQ ID NO: 245 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttcccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcataagtggcaaatcgcaaccgagggcgacaatgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 246 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDNAHIVLMPSTTRQHVDELIADIAAANKAAAAPSDTQKPAAKKRPTPAGAPQRTT

SEQ ID NO: 247 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcatccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgaccgcgcgcatattgtgttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 248 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDRAHIVLMPSTTKQHVDELIADIAAANKAAAAPSDTQKPAAKKRPTPAGAPQRTT

SEQ ID NO: 249 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgctgccatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcataagtggcaaatcgcaaccgagggcgacgatgcgcatattgtgttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 250 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRCHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDDAHIVLMPSTTKQHVDELIADIAAANKAAAAPSDTQKPAAKKRPTPAGAPQRTT

SEQ ID NO: 251 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgcgtcgtaatccatgcgccattaccgttgtgttcccgaaacctccgcagtcagtgctgcataagtggcaaatcgcaaccgagggcgaccgcgcgcatattgtgttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 252 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIVLMPSTTRQHVDELIADIAAANKAAAAPSDTQKPAAKKRPTPAGAPQRTT

SEQ ID NO: 253 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaaggatctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctgcataagtggcaaatcgcaaccgagggcgaccgcgcgcatatttgcttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 254 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKDLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLHKWQIATEGDRAHICLMPSTTKQHVDELIADIAAANKAAAAPSDTQKPAAKKRPTPAGAPQRTT

SEQ ID NO: 255 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaaggatctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaagatcggtgtagaagcgatgcgtaatccatgcgccattaccgttgtgttcccgaaacctccgcagtcagtgctgcataagtggcaaatcgcaaccgagggcgacaatgcgcatatttgcttaatgccaagtaccaccaagcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 256 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKDLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEAMRNPCAITVVFPKPPQSVLHKWQIATEGDNAHICLMPSTTKQHVDELIADIAAANKAAAAPSDTQKPAAKKRPTPAGAPQRTT

SEQ ID NO: 257 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgagtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgtatcggtgtagaagcgatgcgtaatccatgcgccattaccgttgtgttcccgaaacctccgcagtcagtgctggaaaagtggcaaatcgcaaccgagggcgaccgcgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 258 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDRAHICLMPSTTRQHVDELIADIAAANKAAAAPSDTQKPAAKKRPTPAGAPQRTT

SEQ ID NO: 259 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcaatcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcaggggcccgccgccaaggaagatccggccccggctggtgcaccgcaacgtgacacgtag

SEQ ID NO: 260 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANKAAAAPSDTQGPAAKEDPAPAGAPQRDT

SEQ ID NO: 261 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtttaagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcaaccgagggcgaccgcgcgcatattatcttaatgccaagtaccaccctccagcatgtcgatgaattgatcgctgacattgcggccgccaatgatgcggctgcagcaccgagcgatacgcagaaacccgccgccaagaaagatccgaccccggctggtgcaccgcaacgtactacgtag

SEQ ID NO: 262 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVFKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEARRNPCAITVVFPKPPASVLHKWQIATEGDRAHIILMPSTTLQHVDELIADIAAANDAAAAPSDTQKPAAKKDPTPAGAPQRTT

SEQ ID NO: 263 - DNA, 1158 bp, synthetic construct
  misc_feature 1..1158: note = Variant of Leucine Decarboxylase
  source 1..1158: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcaatcagtgctgcacaagtggcaaatcgcaaccgagggcgaccgcgcgcatattatcttaatgccaagtaccaccctccagcatgtcgatgaattgatcgctgacattgcggccgccaatgatgcggctgcagcaccgagctaa

SEQ ID NO: 264 - protein, 385 aa, synthetic construct
  REGION 1..385: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANDAAAAPS

SEQ ID NO: 265 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcagaaaccctaagccaagaaacgcccgacaccggctggtgcaccgcaacgtactacgtag

SEQ ID NO: 266 - protein, 390 aa, synthetic construct
  REGION 1..390: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPASVLHKWQIATEGDRAHIILMPSTTLQHVDELIADIAAANKAAAAPSDTQKP

SEQ ID NO: 267 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcaggggcccgccgccaagaaaaaaccgaccccggctggtgcaccgcaacgtactacgtag

SEQ ID NO: 268 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPASVLHKWQIATEGDRAHIILMPSTTLQHVDELIADIAAANKAAAAPSDTQGPAAKKKPTPAGAPQRTT

SEQ ID NO: 269 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcaatcagtgctgcacaagtggcaaatcgcaaccgagggcgaccgcgcgcatattatcttaatgccaagtaccaccctccagcatgtcgatgaattgatcgctgacattgcggccgccaatgatgcggctgcagcaccgagcgatacgcagaaacccgccgccaaggaagatccggccccggctggtgcaccgcaaattcacacgtag

SEQ ID NO: 270 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANDAAAAPSDTQKPAAKEDPAPAGAPQIHT

SEQ ID NO: 271 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcaatcagtgctgcacaagtggcaaatcgcaaccgagggcgaccgcgcgcatattatcttaatgccaagtaccaccctccagcatgtcgatgaattgatcgctgacattgcggccgccaatgatgcggctgcagcaccgagcgatacgcagaaacccgccgccaaggaaaaaccggccccggctggtgcaccgcaacgtgacacgtag

SEQ ID NO: 272 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANDAAAAPSDTQKPAAKEKPAPAGAPQRDT

SEQ ID NO: 273 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtatcgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcagaaacccgccgccaaggaaaaaccgaccccggctggtgcaccgcaacgtgacacgtag

SEQ ID NO: 274 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPASVLHKWQIATEGDRAHIILMPSTTLQHVDELIADIAAANKAAAAPSDTQKPAAKEKPTPAGAPQRDT

SEQ ID NO: 275 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccgcagtcagtgctgcacaagtggcaaatcgcaaccgagggcgaccgcgcgcatattatcttaatgccaagtaccaccctccagcatgtcgatgaattgatcgctgacattgcggccgccaataaagcggctgcagcaccgagcgatacgcagaaacccgccgccaaggaacgtccggccccggctggtgcaccgcaacgtactacgtag

SEQ ID NO: 276 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPQSVLHKWQIATEGDRAHIILMPSTTLQHVDELIADIAAANKAAAAPSDTQKPAAKERPAPAGAPQRTT

SEQ ID NO: 277 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcattcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgcgtcgtaatccatgcgccattaccgttgtgttcccgaaacctccggcgtcagtgctgcacaagtggcaaatcgcaaccgagggcgaccgcgcgcatattatcttaatgccaagtaccaccctccagcatgtcgatgaattgatcgctgacattgcggccgccaatgatgcggctgcagcaccgagcgatacgcaggggcccgccgccaaggaagatccgaccccggctggtgcaccgcaacgtactacgtag

SEQ ID NO: 278 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRIHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEARRNPCAITVVFPKPPASVLHKWQIATEGDRAHIILMPSTTLQHVDELIADIAAANDAAAAPSDTQGPAAKEDPTPAGAPQRTT

SEQ ID NO: 279 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttctgccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaaaatcggtgtagaagcgatgcgtaatccatgcgccattaccgttgtgttcccgaaacctccggcttcagtgctggaaaagtggcaaatcgcaaccgagggcgacgatgcgcatatttgcttaatgccaagtaccacccgtcagcatgtcgatgaattgatcgctgacattgcggccgccaatgatgcggctgcagcaccgagcgatacgcagaaacccgccgccaagaaacgcccgacaccggctggtgcaccgcaacgtactacg

SEQ ID NO: 280 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKKIGVEAMRNPCAITVVFPKPPASVLEKWQIATEGDDAHICLMPSTTRQHVDELIADIAAANDAAAAPSDTQKPAAKKRPTPAGAPQRTT

SEQ ID NO: 281 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcaatcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 282 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 283 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 284 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 285 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 286 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 287 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtcacacg

SEQ ID NO: 288 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRHT

SEQ ID NO: 289 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttctgccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaaaaaatcggtgtagaagcgatgcgtaatccatgcgccattaccgttgtgttcccgaaacctccgcaatcagtgctggaaaagtggcaaatcgcaaccgagggcgacgatgcgcatatttgcttaatgccaagtaccacccgtcagcatgtcgatgaattgatcgctgacattgcggccgccaatgatgcggctgcagcaccgagcgatacgcagaaacccgccgccaagaaacgcccgacaccggctggtgcaccgcaacgtactacg

SEQ ID NO: 290 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKKIGVEAMRNPCAITVVFPKPPQSVLEKWQIATEGDDAHICLMPSTTRQHVDELIADIAAANDAAAAPSDTQKPAAKKRPTPAGAPQRTT

SEQ ID NO: 291 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcaatcagtgctggaaaagtggcaaatcgcaaccgagggcgacgatgcgcatatttgcttaatgccaagtaccacccgtcagcatgtcgatgaattgatcgctgacattgcggccgccaatgatgcggctgcagcaccgagcgatacgcagaaacccgccgccaagaaacgcccgacaccggctggtgcaccgcaacgtactacg

SEQ ID NO: 292 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANDAAAAPSDTQKPAAKKRPTPAGAPQRTT

SEQ ID NO: 293 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcaatcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 294 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 295 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcttcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 296 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQKPAAKKRPTPAGAPQRTT

SEQ ID NO: 297 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgcatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcttcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 298 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQKPAAKKRPTPAGAPQRTT

SEQ ID NO: 299 - DNA, 1218 bp, synthetic construct
  misc_feature 1..1218: note = Variant of Leucine Decarboxylase
  source 1..1218: mol_type = other DNA
atggagaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 300 - protein, 406 aa, synthetic construct
  REGION 1..406: note = Variant of Leucine Decarboxylase
MENLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 301 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaggctgcagcaccgagcgatacgcagaaacccgccgccaagaaacgcccgacaccggctggtgcaccgcaacgtactacg

SEQ ID NO: 302 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTQKPAAKKRPTPAGAPQRTT

SEQ ID NO: 303 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcaggtggtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 304 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQVVLEKWQIATEGDDAHICLMPSTTRQHVDELIADIAAANKAAAAPSDTQKPAAKKRPTPAGAPQRTT

SEQ ID NO: 305 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctagtgcaccgagcgatacgcagaaacccgccgccaagaaacgcccgacaccggctggtgcaccgcaacgtactacg

SEQ ID NO: 306 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAASAPSDTQKPAAKKRPTPAGAPQRTT

SEQ ID NO: 307 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaagcggccgccaagaaacgcccgacaccggctggtgcaccgcaacgtactacg

SEQ ID NO: 308 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKAAAKKRPTPAGAPQRTT

SEQ ID NO: 309 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaagtgatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 310 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYEVMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 311 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctagttccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 312 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFASSSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 313 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatattttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 314 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDIFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 315 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcattcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 316 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 317 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagacggtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 318 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQTVLEKWQIATEGDDAHICLMPSTTRQHVDELIADIAAANKAAAAPSDTQKPAAKKRPTPAGAPQRTT

SEQ ID NO: 319 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcgttattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 320 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARVIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 321 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaagaggccgccaagaaacgcccgacaccggctggtgcaccgcaacgtactacg

SEQ ID NO: 322 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKEAAKKRPTPAGAPQRTT

SEQ ID NO: 323 - DNA, 1218 bp, synthetic construct
  misc_feature 1..1218: note = Variant of Leucine Decarboxylase
  source 1..1218: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 324 - protein, 406 aa, synthetic construct
  REGION 1..406: note = Variant of Leucine Decarboxylase
MGMLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 325 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaataggccgccaagaaacgcccgacaccggctggtgcaccgcaacgtactacg

SEQ ID NO: 326 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQK

SEQ ID NO: 327 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaaagtgccgccaagaaacgcccgacaccggctggtgcaccgcaacgtactacg

SEQ ID NO: 328 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKSAAKKRPTPAGAPQRTT

SEQ ID NO: 329 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggttagccgcaacgtactacg

SEQ ID NO: 330 - protein, 400 aa, synthetic construct
  REGION 1..400: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAG

SEQ ID NO: 331 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 332 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 333 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggttatccgcaacgtactacg

SEQ ID NO: 334 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGYPQRTT

SEQ ID NO: 335 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccctgatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 336 - protein, 406 aa, synthetic construct
  REGION 1..406: note = Variant of Leucine Decarboxylase
MGNLKFPDGALSPTDRRRLEDVYQYVREQCDTLIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 337 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagttgattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 338 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVELIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 339 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaggacccggctccggctggtgcaccgcaacgtactacg

SEQ ID NO: 340 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKDPAPAGAPQRTT

SEQ ID NO: 341 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaaggagcgcccgactccggctggtgcaccgcaacgtactacg

SEQ ID NO: 342 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKERPTPAGAPQRTT

SEQ ID NO: 343 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaagcgcccggctccggctggtgcaccgcaacgtactacg

SEQ ID NO: 344 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPAPAGAPQRTT

SEQ ID NO: 345 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaagaagccgactccggctggtgcaccgcaacgtactacg

SEQ ID NO: 346 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKKPTPAGAPQRTT

SEQ ID NO: 347 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgaaccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggagaagccggctccggctggtgcaccgcaacgtactacg

SEQ ID NO: 348 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEANRNPCAITVVFPKPPQSVLEKWQIATEGDDAHICLMPSTTRQHVDELIADIAAANKAAAAPSDTQKPAAKEKPAPAGAPQRTT

SEQ ID NO: 349 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaagaagcgcccgactccggctggtgcaccgcaacgtactacg

SEQ ID NO: 350 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKRPTPAGAPQRTT

SEQ ID NO: 351 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggaggacccgactccggctggtgcaccgcaacgtactacg

SEQ ID NO: 352 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKEDPTPAGAPQRTT

SEQ ID NO: 353 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggaggacccggctccggctggtgcaccgcaacgtactacg

SEQ ID NO: 354 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKEDPAPAGAPQRTT

SEQ ID NO: 355 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggagaagccgactccggctggtgcaccgcaacgtactacg

SEQ ID NO: 356 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKEKPTPAGAPQRTT

SEQ ID NO: 357 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggaggacccgactccggctggtgcaccgcaacgtactacg

SEQ ID NO: 358 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQGPAAKEDPTPAGAPQRTT

SEQ ID NO: 359 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggaggacccgactccggctggtgcaccgcaacgtactacg

SEQ ID NO: 360 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKEDPTPAGAPQRTT

SEQ ID NO: 361 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggagcgcccgactccggctggtgcaccgcaacgtactacg

SEQ ID NO: 362 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKERPTPAGAPQRTT

SEQ ID NO: 363 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgaaccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaggacccgactccggctggtgcaccgcaacgtactacg

SEQ ID NO: 364 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEANRNPCAITVVFPKPPQSVLEKWQIATEGDDAHICLMPSTTRQHVDELIADIAAANKAAAAPSDTQKPAAKKDPTPAGAPQRTT

SEQ ID NO: 365 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagcgcccgactccggctggtgcaccgcaacgtactacg

SEQ ID NO: 366 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKERPTPAGAPQRTT

SEQ ID NO: 367 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaagaaggacccgactccggctggtgcaccgcaacgtactacg

SEQ ID NO: 368 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKDPTPAGAPQRTT

SEQ ID NO: 369 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaagaagccgactccggctggtgcaccgcaacgtactacg

SEQ ID NO: 370 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKKKPTPAGAPQRTT

SEQ ID NO: 371 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggagaagccggctccggctggtgcaccgcaacgtactacg

SEQ ID NO: 372 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKEKPAPAGAPQRTT

SEQ ID NO: 373 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagaagccggctccggctggtgcaccgcaacgtactacg

SEQ ID NO: 374 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKEKPAPAGAPQRTT

SEQ ID NO: 375 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagcgcccgactccggctggtgcaccgcaacgtactacg

SEQ ID NO: 376 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQGPAAKERPTPAGAPQRTT

SEQ ID NO: 377 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaagaagaagccgactccggctggtgcaccgcaacgtactacg

SEQ ID NO: 378 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKKPTPAGAPQRTT

SEQ ID NO: 379 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaagaagcgcccggctccggctggtgcaccgcaacgtactacg

SEQ ID NO: 380 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKRPAPAGAPQRTT

SEQ ID NO: 381 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagaagccgactccggctggtgcaccgcaacgtactacg

SEQ ID NO: 382 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKEKPTPAGAPQRTT

SEQ ID NO: 383 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgaaccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaacgcccgacaccggctggtgcaccgcaacgtactacg

SEQ ID NO: 384 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEANRNPCAITVVFPKPPQSVLEKWQIATEGDDAHICLMPSTTRQHVDELIADIAAANKAAAAPSDTQKPAAKKRPTPAGAPQRTT

SEQ ID NO: 385 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagcgcccggctccggctggtgcaccgcaacgtactacg

SEQ ID NO: 386 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKERPAPAGAPQRTT

SEQ ID NO: 387 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggccccgccgccaaggagcgcccggctccggctggtgcaccgcaacgtactacg

SEQ ID NO: 388 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQGPAAKERPAPAGAPQRTT

SEQ ID NO: 389 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctcttttaccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaaggagaagccggctccggctggtgcaccgcaacgtactacg

SEQ ID NO: 390 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLLPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKEKPAPAGAPQRTT

SEQ ID NO: 391 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacgcagggttgagccgccaagaaacgcccgacaccggctggtgcaccgcaacgtactacgtag

SEQ ID NO: 392 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPASVLEKWQIATEGDDAHICLMPSTTRQHVDELIADIAAANKEAAAPSDTQG

SEQ ID NO: 393 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacgcagggttgagccgccaagaaacgcccgacaccggctggtgcaccgcaacgtactacgtag

SEQ ID NO: 394 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQG

SEQ ID NO: 395 - DNA, 1218 bp, synthetic construct
  misc_feature 1..1218: note = Variant of Leucine Decarboxylase
  source 1..1218: mol_type = other DNA
atggggaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggttgagccgccaagaaacgcccgacaccggctggtgcaccgcaacgtactacg

SEQ ID NO: 396 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQG

SEQ ID NO: 397 - DNA, 1221 bp, synthetic construct
  misc_feature 1..1221: note = Variant of Leucine Decarboxylase
  source 1..1221: mol_type = other DNA
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaagcccgccgccaagaaacgcccgacaccggctggtgcaccgcaacgtactacgtag

SEQ ID NO: 398 - protein, 406 aa, synthetic construct
  REGION 1..406: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKEAAAPSDTAKPAAKKRPTPAGAPQRTT

SEQ ID NO: 399 - DNA, 1221 bp, synthetic construct
  misc_feature 1..1221: note = Variant of Leucine Decarboxylase
  source 1..1221: mol_type = other DNA
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacgcagggttgagccgccaagaaacgcccgacaccggctggtgcaccgcaacgtactacgtag

SEQ ID NO: 400 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEASAPSDTQG

SEQ ID NO: 401 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacgcagaagtgagccgccaagaaacgcccgacaccggctggtgcaccgcaacgtactacgtag

SEQ ID NO: 402 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQK

SEQ ID NO: 403 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcggcaccgagcgatacgcagaagtgagccgccaagaaacgcccgacaccggctggtgcaccgcaacgtactacgtag

SEQ ID NO: 404 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQK

SEQ ID NO: 405 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggtcccgccgccaagaaacgcccgacaccggctggtgcaccgcaacgtactacgtag

SEQ ID NO: 406 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKRPTPAGAPQRTT

SEQ ID NO: 407 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaacgcccgacaccggctggtgcaccgcaacgtactacgtag

SEQ ID NO: 408 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 409 - DNA, 1221 bp, synthetic construct; identical to SEQ ID NO: 233
  misc_feature 1..1221: note = Variant of Leucine Decarboxylase
  source 1..1221: mol_type = other DNA

SEQ ID NO: 410 - protein, 406 aa, synthetic construct; identical to SEQ ID NO: 234
  REGION 1..406: note = Variant of Leucine Decarboxylase

SEQ ID NO: 411 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccaatgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagcttcggcaccgagcgatacggccaagtgagccgccaagaaacgcccgacaccggctggtgcaccgcaacgtactacgtag

SEQ ID NO: 412 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPMFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAASAPSDTAK

SEQ ID NO: 413 - DNA, 1221 bp, synthetic construct
  misc_feature 1..1221: note = Variant of Leucine Decarboxylase
  source 1..1221: mol_type = other DNA
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaatgacgaagctgcggcaccgagcgatacggccaagcccgccgccaagaaacgcccgacaccggctggtgcaccgcaacgtactacgtag

SEQ ID NO: 414 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANDEAAAPSDTAKPAAKKRPTPAGAPQRTT

SEQ ID NO: 415 - DNA, 1218 bp, synthetic construct
  misc_feature 1..1218: note = Variant of Leucine Decarboxylase
  source 1..1218: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcgccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcagattgctcgcacgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccggctactgtgctggaaaagtggcaaatcgcaaccgagggcgacgatgcgcatatttgcttaatgccaagtaccacccgtcagcatgtcgatgaattgatcgctgacattgcggccgccaataatgcggctgccgcaccgagcgatacgcagaaacccgccgccaagaaacgcccgacaccggctggtgcaccgcaacgtactacg

SEQ ID NO: 416 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRAIQDMFKKLAIHESHIHCDAALAGMTLPFMDDAPAFDFATGIDSLSISGHKFIGSPMPCGIVLTRKPYVEQIARTIEYIGTLDTTISGSRNGITPLFLWYAVKQAGRDGFKRRVARCLDNARYTVEQFKRIGVEAMRNPCAITVVFPKPPATVLEKWQIATEGDDAHICLMPSTTRQHVDELIADIAAANNAAAAPSDTQKPAAKKRPTPAGAPQRTT

SEQ ID NO: 417 - DNA, 1221 bp, synthetic construct
  misc_feature 1..1221: note = Variant of Leucine Decarboxylase
  source 1..1221: mol_type = other DNA
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacgcagaagcccgccgccaagaaacgcccgacaccggctggtgcaccgcaacgtactacgtag

SEQ ID NO: 418 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQKPAAKKRPTPAGAPQRTT

SEQ ID NO: 419 - DNA, 1221 bp, synthetic construct
  misc_feature 1..1221: note = Variant of Leucine Decarboxylase
  source 1..1221: mol_type = other DNA
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcgtccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaatgacgaagctgcggcaccgagcgatacgcagaagtgagccgccaagaaacgcccgacaccggctggtgcaccgcaacgtactacgtag

SEQ ID NO: 420 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANDEAAAPSDTQK

SEQ ID NO: 421 - DNA, 1218 bp, synthetic construct
  misc_feature 1..1218: note = Variant of Leucine Decarboxylase
  source 1..1218: mol_type = other DNA
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcgacatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaagattgctcgcacgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacg

SEQ ID NO: 422 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRDIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 423 - DNA, 1221 bp, synthetic construct
  misc_feature 1..1221: note = Variant of Leucine Decarboxylase
  source 1..1221: mol_type = other DNA
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcggcaccgagcgatacgcagggtcccgccgccaagaaacgcccgacaccggctggtgcaccgcaacgtactacgtag

SEQ ID NO: 424 - protein, 406 aa, synthetic construct
  REGION 1..406: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQGPAAKKRPTPAGAPQRTT

SEQ ID NO: 425 - DNA, 1218 bp, synthetic construct
  misc_feature 1..1218: note = Variant of Leucine Decarboxylase
  source 1..1218: mol_type = other DNA
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccaatgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacggccaagcccgccgccaagaaacgcccgacaccggctggtgcaccgcaacgtactacg

SEQ ID NO: 426 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPMFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTAKPAAKKRPTPAGAPQRTT

SEQ ID NO: 427 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcgtccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggttgagccgccaagaaacgcccgacaccggctggtgcaccgcaacgtactacgtag

SEQ ID NO: 428 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQG

SEQ ID NO: 429 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacggccaagcccgccgccaagaaacgcccgacaccggctggtgcaccgcaacgtactacgtag

SEQ ID NO: 430 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTAKPAAKKRPTPAGAPQRTT

SEQ ID NO: 431 - DNA, 1221 bp, synthetic construct
  misc_feature 1..1221: note = Variant of Leucine Decarboxylase
  source 1..1221: mol_type = other DNA
atggagaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccggtcccgccgccaagaaacgcccgacaccggctggtgcaccgcaacgtactacgtag

SEQ ID NO: 432 - protein, 406 aa, synthetic construct
  REGION 1..406: note = Variant of Leucine Decarboxylase
MENLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEASAPSDTAGPAAKKRPTPAGAPQRTT

SEQ ID NO: 433 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcgtccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagggttgagccgccaagaaacgcccgacaccggctggtgcaccgcaacgtactacgtag

SEQ ID NO: 434 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPASVLEKWQIATEGDDAHICLMPSTTRQHVDELIADIAAANKAAAAPSDTQG

SEQ ID NO: 435 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccaatgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaatgacgaagcttcggcaccgagcgatacggccaagtgagccgccaagaaacgcccgacaccggctggtgcaccgcaacgtactacgtag

SEQ ID NO: 436 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPMFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANDEASAPSDTAK

SEQ ID NO: 437 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcagcttcggcaccgagcgatacggccggtcccgccgccaagaaacgcccgacaccggctggtgcaccgcaacgtactacgtag

SEQ ID NO: 438 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAASAPSDTAGPAAKKRPTPAGAPQRTT

SEQ ID NO: 439 - DNA, 1221 bp, synthetic construct
  misc_feature 1..1221: note = Variant of Leucine Decarboxylase
  source 1..1221: mol_type = other DNA
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagtgagccgccaagaaacgcccgacaccggctggtgcaccgcaacgtactacgtag

SEQ ID NO: 440 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQK

SEQ ID NO: 441 - DNA, 1221 bp, synthetic construct
  misc_feature 1..1221: note = Variant of Leucine Decarboxylase
  source 1..1221: mol_type = other DNA
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcggcaccgagcgatacgcagaagtgagccgccaagaaacgcccgacaccggctggtgcaccgcaacgtactacgtag

SEQ ID NO: 442 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQK

SEQ ID NO: 443 - DNA, 1221 bp, synthetic construct
  misc_feature 1..1221: note = Variant of Leucine Decarboxylase
  source 1..1221: mol_type = other DNA
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaacgcccgacaccggctggtgcaccgcaacgtactacgtag

SEQ ID NO: 444 - protein, 406 aa, synthetic construct
  REGION 1..406: note = Variant of Leucine Decarboxylase
MGMLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKKRPTPAGAPQRTT

SEQ ID NO: 445 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctacttttcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 446 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYFSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 447 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccaatgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacggccggttgagccgccaagaaacgcccgacaccggctggtgcaccgcaacgtactacgtag

SEQ ID NO: 448 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPMFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTAG

SEQ ID NO: 449 - DNA, 1221 bp, synthetic construct
  misc_feature 1..1221: note = Variant of Leucine Decarboxylase
  source 1..1221: mol_type = other DNA
atgggtaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcgtccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaagcccgccgccaagaaacgcccgacaccggctggtgcaccgcaacgtactacgtag

SEQ ID NO: 450 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 451 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgcgtccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaacattatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagctgcggcaccgagcgatacgcagaagcccgccgccaagaaacgcccgacaccggctggtgcaccgcaacgtactacgtag

SEQ ID NO: 452 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAASSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKHYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 453 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcagcttcggcaccgagcgatacgcagaagtgagccgccaagaaacgcccgacaccggctggtgcaccgcaacgtactacgtag

SEQ ID NO: 454 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAASAPSDTQK

SEQ ID NO: 455 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacgcagaagcccgccgccaagaaacgcccgacaccggctggtgcaccgcaacgtactacgtag

SEQ ID NO: 456 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEAAAPSDTQKPAAKKRPTPAGAPQRTT

SEQ ID NO: 457 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 458 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKKRPTPAGAPQRTT

SEQ ID NO: 459 - DNA, 1221 bp, synthetic construct
  misc_feature 1..1221: note = Variant of Leucine Decarboxylase
  source 1..1221: mol_type = other DNA
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 460 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 461 - DNA, 1221 bp, synthetic construct
  misc_feature 1..1221: note = Variant of Leucine Decarboxylase
  source 1..1221: mol_type = other DNA
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccggcgtcagtgctggaaaagtggcaaatcgcaaccgagggcgacgatgcgcatatttgcttaatgccaagtaccacccgtcagcatgtcgatgaattgatcgctgacattgcggccgccaataaagcggctgcggcaccgagcgatacgcagaagcccgccgccaagaaacgcccgacaccggctggtgcaccgcaacgtactacgtag

SEQ ID NO: 462 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPASVLEKWQIATEGDDAHICLMPSTTRQHVDELIADIAAANKAAAAPSDTQKPAAKKRPTPAGAPQRTT

SEQ ID NO: 463 - DNA, 1221 bp, synthetic construct
  misc_feature 1..1221: note = Variant of Leucine Decarboxylase
  source 1..1221: mol_type = other DNA
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 464 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKAAAAPSDTQKPAAKKRPTPAGAPQRTT

SEQ ID NO: 465 - DNA, 1221 bp, synthetic construct
  misc_feature 1..1221: note = Variant of Leucine Decarboxylase
  source 1..1221: mol_type = other DNA
atggggatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgagtccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcactattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacgcagaagcccgccgccaagaaacgcccgacaccggctggtgcaccgcaacgtactacgtag

SEQ ID NO: 466 - protein, 406 aa, synthetic construct
  REGION 1..406: note = Variant of Leucine Decarboxylase
MGMLKFPDGALSPTDRRRLEDVYQYVREQCDTFIGYPCNMHFDYTPLFPFLAYPVNNVGDPFAESSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTQKPAAKKRPTPAGAPQRTT

SEQ ID NO: 467 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaagattgctcgcacgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccggctactgtgctggaaaagtggcaaatcgcaaccgagggcgacgatgcgcatatttgcttaatgccaagtaccacccgtcagcatgtcgatgaattgatcgctgacattgcggccgccaataatgcggctgccgcaccgagcgatacgcagaaacccgccgccaagaaacgcccgacaccggctggtgcaccgcaacgtactacgtag

SEQ ID NO: 468 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPATVLEKWQIATEGDDAHICLMPSTTRQHVDELIADIAAANNAAAAPSDTQKPAAKKRPTPAGAPQRTT

SEQ ID NO: 469 - DNA, 1221 bp, synthetic construct
  misc_feature 1..1221: note = Variant of Leucine Decarboxylase
  source 1..1221: mol_type = other DNA
atggggaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaagattgctcgcacgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 470 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 471 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgggcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaagattgctcgcacgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagcggctgcagcaccgagcgatacgcagaaacccgccgccaagaaacgcccgacaccggctggtgcaccgcaacgtactacgtag

SEQ ID NO: 472 - protein, 406 aa, synthetic construct
  REGION 1..406: note = Variant of Leucine Decarboxylase
MGNLKFPDGALGPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 473 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgctcgattgaatatatcggtaccctggacactacgatttcgggcagccgtaatggtattacaccgctgtttctttggtacgcggtgaaacaagctggacgcgatggcttcaaacgtcgtgttgcggcttgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaatgatgaggctgccgcaccgagcgatacgcagaaacccgccgccaagaaacgcccgacaccggctggtgcaccgcaacgtactacgtag

SEQ ID NO: 474 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANDEAAAPSDTQKPAAKKRPTPAGAPQRTT

SEQ ID NO: 475 - DNA, 1221 bp, synthetic construct
  misc_feature 1..1221: note = Variant of Leucine Decarboxylase
  source 1..1221: mol_type = other DNA
atgggtaatctgaaatttccagatggcgcgttgggcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatgtgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaagattgctcgcacgattgaatatatcggtaccctggacactacgatttcgggcagccgtaatggtattacaccgctgtttctttggtacgcggtgaaacaagctggacgcgatggcttcaaacgtcgtgttgcggcttgtctggataacgcccgctatacggtcgagcagtttaaacgcatcggtgtagaagcgatgcgtaatccatgcgccattaccgttgtgttcccgaaacctccgcaaagtgtgctggaaaagtggcaaatcgcaaccgagggcgacgatgcgcatatttgcttaatgccaagtaccacccgtcagcatgtcgatgaattgatcgctgacattgcggccgccaataaagcggctgccgcaccgagcgatacgcagaaacccgccgccaagaaacgcccgacaccggctggtgcaccgcaacgtactacgtag

SEQ ID NO: 476 - protein, 406 aa, synthetic construct
  REGION 1..406: note = Variant of Leucine Decarboxylase
MGNLKFPDGALGPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNVRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAAAPSDTQKPAAKKRPTPAGAPQRTT

SEQ ID NO: 477 - DNA, 1218 bp, synthetic construct
  misc_feature 1..1218: note = Variant of Leucine Decarboxylase
  source 1..1218: mol_type = other DNA
atggggaacctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccgcaaagtgtgctggaaaagtggcaaatcgcaaccgagggcgacgatgcgcatatttgcttaatgccaagtaccacccgtcagcatgtcgatgaattgatcgctgacattgcggccgccaatgaggcggctggcgcaccgagcgatacgcagaaacccgccgccaagaaacgcccgacaccggctggtgcaccgcaacgtactacg

SEQ ID NO: 478 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANEAAGAPSDTQKPAAKKRPTPAGAPQRTT

SEQ ID NO: 479 - DNA, 1221 bp, synthetic construct
  misc_feature 1..1221: note = Variant of Leucine Decarboxylase
  source 1..1221: mol_type = other DNA
atggggaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgctcgattgaatatatcggtaccctggacactacgatttcgggcagccgtaatggtattacaccgctgtttctttggtacgcggtgaaacaagctggacgcgatggcttcaaacgtcgtgttgcgcgttgtctggataacgcccgctatacggtcgagcagtttaaacgcatcggtgtagaagcgatgcgtaatccatgcgccattaccgttgtgttcccgaaacctccgcaaactgtgctggaaaagtggcaaatcgcaaccgagggcgacgatgcgcatatttgcttaatgccaagtaccacccgtcagcatgtcgatgaattgatcgctgacattgcggccgccaatgatgaggctggcgcaccgagcgatacgcagaaacccgccgccaagaaacgcccgacaccggctggtgcaccgcaacgtactacgtag

SEQ ID NO: 480 - protein, 406 aa, synthetic construct
  REGION 1..406: note = Variant of Leucine Decarboxylase
MGNLKFPDGALSPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEAMRNPCAITVVFPKPPQTVLEKWQIATEGDDAHICLMPSTTRQHVDELIADIAAANDEAGAPSDTQKPAAKKRPTPAGAPQRTT

SEQ ID NO: 481 - DNA, 1221 bp, synthetic construct
  misc_feature 1..1221: note = Variant of Leucine Decarboxylase
  source 1..1221: mol_type = other DNA
atggggaatctgaaatttccagatggcgcgttgggcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctgaatccagttatcgcgtgcatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatgtgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcggcttgtctggataacgcccgctatacggtcgagcagtttaaacgcatcggtgtagaagcgatgcgtaatccatgcgccattaccgttgtgttcccgaaacctccgcaaagtgtgctggaaaagtggcaaatcgcaaccgagggcgacgatgcgcatatttgcttaatgccaagtaccacccgtcagcatgtcgatgaattgatcgctgacattgcggccgccaataaggcggctggcgcaccgagcgatacgcagaaacccgccgccaagaaacgcccgacaccggctggtgcaccgcaacgtactacgtag

SEQ ID NO: 482 - protein, 406 aa, synthetic construct
  REGION 1..406: note = Variant of Leucine Decarboxylase
MGNLKFPDGALGPTDRRRLEDVYQYVREQCDTFIGYPCNMHFDYTPLFPFLAYPVNNVGDPFAESSYRVHTREIEREVLAWFAELMHIAPEEYWGYVTNGGSEGNLYGLFLARERFPTGVAYYSEDSHYSVYKNVRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKAAGAPSDTQKPAAKKRPTPAGAPQRTT

SEQ ID NO: 483 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 484 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 485 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 486 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 487 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 488 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 489 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 490 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 491 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccggcctcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 492 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEASRNPCAITVVFPKPPASVLEKWQIATEGDDAHICLMPSTTRQHVDELIADIAAANKEAAAPSDTAK

SEQ ID NO: 493 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 494 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 495 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 496 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 497 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaggaagcttcggcaccgagcgatacggccaag

SEQ ID NO: 498 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEASAPSDTAK

SEQ ID NO: 499 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccaag

SEQ ID NO: 500 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEASAPSDTAK

SEQ ID NO: 501 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagcattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcagcaccgagcgatacggccaag

SEQ ID NO: 502 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEAAAPSDTAK

SEQ ID NO: 503 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaggaagcttcggcaccgagcgatacggccaag

SEQ ID NO: 504 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEASAPSDTAK

SEQ ID NO: 505 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccggcctcagtgctggaaaagtggcaaatcgcaaccgagggcgacgatgcgcatatttgcttaatgccaagtaccacccgtcagcatgtcgatgaattgatcgctgacattgcggccgccaataaagaagctgcagcaccgagcgatacggccaag

SEQ ID NO: 506 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEASRNPCAITVVFPKPPASVLEKWQIATEGDDAHICLMPSTTRQHVDELIADIAAANKEAAAPSDTAK

SEQ ID NO: 507 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 508 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEAAAPSDTAK

SEQ ID NO: 509 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 510 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 511 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 512 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 513 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccaag

SEQ ID NO: 514 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEASAPSDTAK

SEQ ID NO: 515 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 516 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 517 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 518 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 519 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 520 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEAAAPSDTAK

SEQ ID NO: 521 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 522 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 523 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccggcctcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 524 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPASVLEKWQIATEGDDAHICLMPSTTRQHVDELIADIAAANKEAAAPSDTAK

SEQ ID NO: 525 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaggaagcttcggcaccgagcgatacggccaag

SEQ ID NO: 526 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEASAPSDTAK

SEQ ID NO: 527 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccaag

SEQ ID NO: 528 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEASRNPCAITVVFPKPPQSVLEKWQIATEGDDAHICLMPSTTRQHVDELIADIAAANKEASAPSDTAK

SEQ ID NO: 529 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 530 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 531 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 532 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 533 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 534 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 535 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaatgatgaagctgcagcaccgagcgatacggccaag

SEQ ID NO: 536 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANDEAAAPSDTAK

SEQ ID NO: 537 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccaag

SEQ ID NO: 538 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEASAPSDTAK

SEQ ID NO: 539 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccggcctcagtgctggaaaagtggcaaatcgcaaccgagggcgacgatgcgcatatttgcttaatgccaagtaccacccgtcagcatgtcgatgaattgatcgctgacattgcggccgccaataaagaagcttcggcaccgagcgatacggccaag

SEQ ID NO: 540 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEASRNPCAITVVFPKPPASVLEKWQIATEGDDAHICLMPSTTRQHVDELIADIAAANKEASAPSDTAK

SEQ ID NO: 541 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcacgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 542 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARTIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 543 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctcgcagcattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaggaagcttcggcaccgagcgatacggccaag

SEQ ID NO: 544 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEASAPSDTAK

SEQ ID NO: 545 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgcctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctcgcacgattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgtcgcgtaatccatgcgccattaccgttgtgttcccgaaacctccggcctcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 546 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARTIEYIGTLDTTISGSRNGITPLFLWYAVKQAGRDGFKRRVARCLDNARYTVEQFKRIGVEASRNPCAITVVFPKPPASVLEKWQIATEGDDAHICLMPSTTRQHVDELIADIAAANKEAAAPSDTAK

SEQ ID NO: 547 - DNA, 1167 bp, synthetic construct
  misc_feature 1..1167: note = Variant of Leucine Decarboxylase
  source 1..1167: mol_type = other DNA
atgggtatgctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgctcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcgcgctgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 548 - protein, 389 aa, synthetic construct
  REGION 1..389: note = Variant of Leucine Decarboxylase
MGMLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMLKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVARCLDNARYTVEQFKRIGVEAMRNPCAITVVFPKPPQSVLEKWQIATEGDDAHICLMPSTTRQHVDELIADIAAANKEAAAPSDTAK

SEQ ID NO: 549 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaatgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcattggtgtagaagcgatgcgtaatccaaacgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 550 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPNAITVVFPKPPQSVLEKWQIATEGDDAHICLMPSTTRQHVDELIADIAAANKEAAAPSDTAK

SEQ ID NO: 551 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcgtattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaatgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcattggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtgagcatgtcgatgaattgatcgctgacattgcggccgccaataaagaagccgcggcaccgagcgatacggccaag

SEQ ID NO: 552 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMRIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTREHVDELIADIAAANKEAAAPSDTAK

SEQ ID NO: 553 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcattggtgtagaagcgatgcgtaatccaaacgccattaccgttgtgttcccgaaaccttcgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 554 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPNAITVVFPKPSQSVLEKWQIATEGDDAHICLMPSTTRQHVDELIADIAAANKEAAAPSDTAK

SEQ ID NO: 555 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcattggtgtagaagcgatgcgtaatccaaacgccattaccgttgtgttcccgaaaccttcgcagtcagtgctggaaaagtggcaaatcgcaaccgagggcgacgatgcgcatatttgcttaatgccaagtaccacccgtgagcatgtcgatgaattgatcgctgacattgcggccgccaataaagaagctgcggcaccgagcgatacggccaag

SEQ ID NO: 556 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPNAITVVFPKPSQSVLEKWQIATEGDDAHICLMPSTTREHVDELIADIAAANKEAAAPSDTAK

SEQ ID NO: 557 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggtgatctctacgaaactatgcgcgctcatcgtgattgcccgccgatcatcttcgctaacattggtacgacgatgaccgaaggcattgacaatgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 558 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 559 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggtgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcgcaggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 560 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRAGVEAMRNPCAITVVFPKPPQSVLEKWQIATEGDDAHICLMPSTTRQHVDELIADIAAANKEAAAPSDTAK

SEQ ID NO: 561 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcgtattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccaaacgccattaccgttgtgttcccgaaacctccgcagtcagtgctggaaaagtggcaaatcgcaaccgagggcgacgatgcgcatatttgcttaatgccaagtaccacccgtgagcatgtcgatgaattgatcgctgacattgcggccgccaataaagaagccgcggcaccgagcgatacggccaag

SEQ ID NO: 562 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMRIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPNAITVVFPKPPQSVLEKWQIATEGDDAHICLMPSTTREHVDELIADIAAANKEAAAPSDTAK

SEQ ID NO: 563 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtgagcatgtcgatgaattgatcgctgacattgcggccgccaataaagaagctgcggcaccgagcgatacggccaag

SEQ ID NO: 564 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTREHVDELIADIAAANKEAAAPSDTAK

SEQ ID NO: 565 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcatattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataaaccgccgatcatcttcgctaacattggtacgacgatgaccgaaggcattgacaatgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcattggtgtagaagcgatgcgtaatccaaacgccattaccgttgtgttcccgaaaccttcgcagtcagtgctggaaaagtggcaaatcgcaaccgagggcgacgatgcgcatatttgcttaatgccaagtaccacccgtcagcatgtcgatgaattgatcgctgacattgcggccgccaataaagaagccgcggcaccgagcgatacggccaag

SEQ ID NO: 566 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPNAITVVFPKPSQSVLEKWQIATEGDDAHICLMPSTTRQHVDELIADIAAANKEAAAPSDTAK

SEQ ID NO: 567 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcgtattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaatgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtacccgcgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagccgcggcaccgagcgatacggccaag

SEQ ID NO: 568 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMRIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 569 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctgggagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 570 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIAGSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 571 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgcgggaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 572 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMREGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 573 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagactgtcgatgaattgatcgctgacattgcggccgccaataaagaagctgcggcaccgagcgatacggccaag

SEQ ID NO: 574 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQTVDELIADIAAANKEAAAPSDTAK

SEQ ID NO: 575 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcaggtcgatgaattgatcgctgacattgcggccgccaataaagaagctgcggcaccgagcgatacggccaag

SEQ ID NO: 576 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQQVDELIADIAAANKEAAAPSDTAK

SEQ ID NO: 577 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaaaagtactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 578 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEKYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 579 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatggttgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 580 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMVEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 581 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgctgaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 582 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMLKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 583 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgttttgtagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 584 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFCSSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 585 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttgggtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 586 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPWVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 587 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacgctgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 588 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYADLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 589 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 590 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 591 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctgatagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 592 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIADSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 593 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 594 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 595 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcatagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 596 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIAHSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 597 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgtgtaagaaactggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 598 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMCKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 599 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagcttcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 600 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEASHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 601 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgcggatgcgcatatttgcttaatgccaagtaccacccgtcagcatgtcgatgaattgatcgctgacattgcggccgccaataaagaagctgcggcaccgagcgatacggccaag

SEQ ID NO: 602 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGADAHICLMPSTTRQHVDELIADIAAANKEAAAPSDTAK

SEQ ID NO: 603 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaaactggcgattcacgattctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 604 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHDSHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 605 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccagcgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 606 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 607 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcttgtcgatgaattgatcgctgacattgcggccgccaataaagaagctgcggcaccgagcgatacggccaag

SEQ ID NO: 608 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQLVDELIADIAAANKEAAAPSDTAK

SEQ ID NO: 609 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgcttctagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 610 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIASSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 611 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 612 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 613 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcaggttgtcgatgaattgatcgctgacattgcggccgccaataaagaagctgcggcaccgagcgatacggccaag

SEQ ID NO: 614 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQVVDELIADIAAANKEAAAPSDTAK

SEQ ID NO: 615 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaaacttcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 616 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 617 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaaggaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 618 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMKEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 619 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgggttggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 620 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLGWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 621 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagcggaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 622 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPAEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 623 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacgttcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 624 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNVRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 625 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcaggctgtcgatgaattgatcgctgacattgcggccgccaataaagaagctgcggcaccgagcgatacggccaag

SEQ ID NO: 626 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQAVDELIADIAAANKEAAAPSDTAK

SEQ ID NO: 627 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacagtgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 628 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYSDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 629 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcttggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 630 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIERLVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 631 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccacaggaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 632 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPQEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 633 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctattagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 634 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIAISIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 635 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgacgttcgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctcgcagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 636 - protein, 389 aa, synthetic construct
  REGION 1..389: note = Variant of Leucine Decarboxylase
MGNLKFPDGALSPTDVRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIARSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 637 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccaaatgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 638 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPNAITVVFPKPPQSVLEKWQIATEGDDAHICLMPSTTRQMVDELIADIAAANKEAAAPSDTAK

SEQ ID NO: 639 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgttttgtagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgcgcgaaggcattgacaacgtacgcaccatccaggatatgtgcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccaaatgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 640 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFCSSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDCPPIIFANIGTTMREGIDNVRTIQDMCKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEASRNPNAITVVFPKPPQSVLEKWQIATEGDDAHICLMPSTTRQMVDELIADIAAANKEAAAPSDTAK

SEQ ID NO: 641 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcatggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccaaatgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 642 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPNAITVVFPKPPQSVLEKWQIATEGDDAHICLMPSTTRQMVDELIADIAAANKEAAAPSDTAK

SEQ ID NO: 643 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaggaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgcgcgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 644 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDCPPIIFANIGTTMREGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 645 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagcatgtcgatgaattgatcgctgacattgcggccgccaataaagaagctgcggcaccgagcgatacggccaag

SEQ ID NO: 646 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEAAAPSDTAK

SEQ ID NO: 647 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgactgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 648 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 649 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcatggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 650 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 651 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 652 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 653 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 654 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 655 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcatggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccaaatgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 656 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPNAITVVFPKPPQSVLEKWQIATEGDDAHICLMPSTTRQMVDELIADIAAANKEAAAPSDTAK

SEQ ID NO: 657 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 658 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 659 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgattgcccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctactacgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccaaatgccattaccgttgtgttcccgaaacctccgcagtcagtgctggaaaagtggcaaatcgcaaccgagggcgacgatgcgcatatttgcttaatgccaagtaccacccgtcagcacgtcgatgaattgatcgctgacattgcggccgccaataaagaagctgcggcaccgagcgatacggccaag

SEQ ID NO: 660 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVEKIATTIEYIGTLDTTISGSRNGITPLFLWYAVKQAGRDGFKRRVAACLDNARYTVEQFKRIGVEAMRNPNAITVVFPKPPQSVLEKWQIATEGDDAHICLMPSTTRQHVDELIADIAAANKEAAAPSDTAK

SEQ ID NO: 661 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgattgtccgccgatcatcttcgctaacattggtacgacgatgactgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgcgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 662 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDCPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 663 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 664 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 665 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagcacgtcgatgaattgatcgctgacattgcggccgccaataaagaagctgcggcaccgagcgatacggccaag

SEQ ID NO: 666 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQHVDELIADIAAANKEAAAPSDTAK

SEQ ID NO: 667 - DNA, 1167 bp, synthetic construct
  misc_feature 1..1167: note = Variant of Leucine Decarboxylase
  source 1..1167: mol_type = other DNA
atgggtaatctgaaatttccagacggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 668 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 669 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgttttgtagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 670 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFCSSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 671 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcatggttcgccgaactcatgcacattgcaccagcggaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 672 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPAEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 673 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgttttgtagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccaaatgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 674 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFCSSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEAMRNPNAITVVFPKPPQSVLEKWQIATEGDDAHICLMPSTTRQMVDELIADIAAANKEAAAPSDTAK

SEQ ID NO: 675 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaaacgtcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 676 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 677 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaggaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 678 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 679 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgtattgctactagtattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagcacgtcgatgaattgatcgctgacattgcggccgccaataaagaagctgcggcaccgagcgatacggccaag

SEQ ID NO: 680 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTLDTTISGSRNGITPLFLWYAVKQAGRDGFKRRVAACLDNARYTVEQFKRIGVEASRNPCAITVVFPKPPQSVLEKWQIATEGDDAHICLMPSTTRQHVDELIADIAAANKEAAAPSDTAK

SEQ ID NO: 681 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgctagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 682 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 683 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccgccgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaggaatactggggttatgtgactaatggaggatcggagggcaacctgtacggtttgtttttagcgcgtgaacgctttcctacgggcgtcgcctactattcggaagactcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagcgcattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 684 - protein, 389 aa, synthetic construct
  REGION 1..389: note = Variant of Leucine Decarboxylase
MGNLKFPDGALSPTDRRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVERIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 685 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 686 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 687 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaaaagcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 688 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGLFLARERFPDGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 689 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaacgtcgtgttcaggcatgtctggataacgcccgctatacggtcgagcaatttcagcgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 690 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGLFLARERFPDGVAYYSEDSHYSVYKNLRLLNMRHIMIKSQPNGEIDYGDLYETMRAHRDKPPIIFANIGTTMTEGIDNVRTIQDMFKKLAISESHIHCDAALAGMTLPFMDDAPAFDFATGIDSLSISGHKFIGSPMPCGIVLTRKPYVEKIATSIEYIGTLDTTISGSRNGITPLFLWYAVKQAGREGFKRRVQACLDNARYTVEQFQRIGVEAMRNPCAITVVFPKPPQSVLEKWQIATEGDDAHICLMPSTTRQMVDELIADIAAANKEAAAPSDTAK

SEQ ID NO: 691 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcctcacatcgtgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctgggtattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaaaagcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 692 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMPHIVIKSQPNGEIDYGDLYETMRAHRDKPPIIFANIGTTMTEGIDNVRTIQDMFKKLGISESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 693 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatccagtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 694 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGLFLARERFPDGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGREGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 695 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattccaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 696 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIPPEEYWGYVTNGGSEGNLYGLFLARERFPDGVAYYSEDSHYSVYKNLRLLNMRHIMIKSQPNGEIDYGDLYETMRAHRDKPPIIFANIGTTMTEGIDNVRTIQDMFKKLAISESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 697 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagctatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcctcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 698 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPDGVAYYSEDSHYSVYKNLRLLNMPHIMIKSQPNGEIDYGDLYETMRAHRDKPPIIFANIGTTMTEGIDNVRTIQDMFKKLAISESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 699 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagctatcgcatccatacccgtgaaatcgaagtcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcctcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctgggtattagtcgctctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaaaagcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 700 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEVEVLAWFAELMHIAPEEYWGYVTNGGSEGNLYGLFLARERFPTGVAYYSEDSHYSVYKNLRLLNMPHIMIKSQPNGEIDYGDLYETMRAHRDKPPIIFANIGTTMTEGIDNVRTIQDMFKKLGISRSHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 701 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaagtcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcctcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattcatcgctctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaaaagcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 702 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSNYRIHTREIEVEVLAWFAELMHIAPEEYWGYVTNGGSEGNLYGLFLARERFPDGVAYYSEDSHYSVYKNLRLLNMPHIMIKSQPNGEIDYGDLYETMRAHRDKPPIIFANIGTTMTEGIDNVRTIQDMFKKLAIHRSHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 703 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagctatcgcatccatacccgtgaaatcgaagtcgaggttctggcgtggttcgccgaactcatgcacattgcaccagaagaatactggggttatgtgactaatggaggatcggagggcaacctgtacggtttgtttttagcgcgtgaacgctttcctgatggcgtcgcctactattcggaagattcgcattatagcgtgtataagaatctgcgtctgctgaacatgcctcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 704 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEVEVLAWFAELMHIAPEEYWGYVTNGGSEGNLYGLFLARERFPDGVAYYSEDSHYSVYKNLRLLNMPHIMIKSQPNGEIDYGDLYETMRAHRDKPPIIFANIGTTMTEGIDNVRTIQDMFKKLAISESHIHCDAALAGMTLPFMDDAPAFDFATGIDSLSISGHKFIGSPMPCGIVLTRKPYVEKIATSIEYIGTLDTTISGSRNGITPLFLWYAVKQAGREGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 705 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctaccggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggctattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcaatttaagcgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 706 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAISESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 707 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaagtcgaggttctggcgtggttcgccgaactcatgcacattgcaccagaagaatactggggttatgtgactaatggaggatcggagggcaacctgtacggtttgtttttagcgcgtgaacgctttcctaccggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctgggtattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaacgtcgtgttcaggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 708 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSNYRIHTREIEVEVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLGISESHIHCDAALAGMTLPFMDDAPAFDFATGIDSLSISGHKFIGSPMPCGIVLTRKPYVEKIATSIEYIGTLDTTISGSRNGITPLFLWYAVKQAGREGFKRRVQACLDNARYTVEQFKRIGVEAMRNPCAITVVFPKPPQSVLEKWQIATEGDDAHICLMPSTTRQMVDELIADIAAANKEAAAPSDTAK

SEQ ID NO: 709 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaagtcgaggttctggcgtggttcgccgaactcatgcacattgcaccagaagaatactggggttatgtgactaatggaggatcggagggcaacctgtacggtttgtttttagcgcgtgaacgctttcctaccggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctgggtattagtgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaaaagcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 710 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSNYRIHTREIEVEVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLGISESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 711 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaaacttcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 712 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 713 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgattctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgctgatgcgcatatttgcttaatgccaagtaccacccgtcagatggtcgatgaattgatcgctgacattgcggccgccaataaagaagctgcggcaccgagcgatacggccaag

SEQ ID NO: 714 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHDSHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGADAHICLMPSTTRQMVDELIADIAAANKEAAAPSDTAK

SEQ ID NO: 715 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacgcggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 716 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYADLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 717 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaaacttcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgattctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 718 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHDSHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 719 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgattctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 720 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHDSHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 721 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 722 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 723 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaaacttcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 724 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSETSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 725 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacatgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgctgatgcgcatatttgcttaatgccaagtaccacccgtcagatggtcgatgaattgatcgctgacattgcggccgccaataaagaagctgcggcaccgagcgatacggccaag

SEQ ID NO: 726 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNMYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEASRNPCAITVVFPKPPQSVLEKWQIATEGADAHICLMPSTTRQMVDELIADIAAANKEAAAPSDTAK

SEQ ID NO: 727 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctagcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 728 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 729 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacgcggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 730 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYADLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 731 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgattctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 732 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHDSHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 733 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttacgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgagccgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 734 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEASRNPCAITVVFPKPPQSVLEKWQIATEGDDAHICLMPSTTRQMVDELIADIAAANKEAAAPSDTAK

SEQ ID NO: 735 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctgaagtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggggatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgatgatgcgcatatttgcttaatgccaagtaccacccgtcagatggtcgatgaattgatcgctgacattgcggccgccaataaagaagctgcggcaccgagcgatacggccaag

SEQ ID NO: 736 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLKWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 737 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 738 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 739 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagtctctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 740 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKSLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 741 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcactgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 742 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIITANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 743 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggctatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 744 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPAIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 745 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctacatgtcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 746 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYMSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 747 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacttgcgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 748 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNLRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 749 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattatctgggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 750 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 751 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcattgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 752 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIIANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 753 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtgggtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 754 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 755 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataaggcgctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 756 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKALRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 757 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatgcggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 758 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 759 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctacgtttcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 760 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYVSEDSHYSVYKNLRLLNMRHIMIKSQPNGEIDYGDLYETMRAHRDKPPIIFANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 761 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtttgtttttagcgcgtgaacgctttcctacgggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcgcggctaacattggtacgacgatgaccgaaggcattgacaacgtacgcaccatccaggatatgttcaagaagctggcgattcacgaatctcatatccattgtgacgcagcattagcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgatggcttcaaacgtcgtgttgcggcatgtctggataacgcccgctatacggtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 762 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGLFLARERFPTGVAYYSEDSHYSVYKNLRLLNMRHIMIKSQPNGEIDYGDLYETMRAHRDKPPIIAANIGTTMTEGIDNVRTIQDMFKKLAIHESHIHCDAALAGMTLPFMDDAPAFDFATGIDSLSISGHKFIGSPMPCGIVLTRKPYVEKIATSIEYIGTLDTTISGSRNGITPLFLWYAVKQAGRDGFKRRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 763 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 764 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYYSEDSHYSVYKNLRLLNMRHIMIKSQPNGEIDYGDLYETMRAHRDKPPIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 765 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 766 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 767 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacgtctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctgggtattcatgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 768 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYVSEDSHYSVYKNLRLLNMPHIMIKSQPNGEIDYGDLYETMRAHRDKPAIIFANIGTTMTEGIDNVRTIQDMFKKLGIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 769 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 770 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYYSEDSHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 771 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccaatcatctttgctaacattggtacgacgatgaccgaaggcattgacaacgtgcgcaccatccaggatatgttcaagaagctggcgattcatgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 772 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYYSEDSHYSVYKNLRLLNMRHIMIKSQPNGEIDYGDLYETMRAHRDKPPIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 773 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccgatcatcttcgctaacattggtacgacgatgaccgaaggcattgacaacgtgcgcaccatccaggatatgttcaagaagctgggtattagtgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 774 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPPIIFANIGTTMTEGIDNVRTIQDMFKKLGISESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 775 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctactattcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 776 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYYSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 777 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacgtctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctgggtattagtgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 778 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYVSEDSHYSVYKNLRLLNMPHIMIKSQPNGEIDYGDLYETMRAHRDKPAIIFANIGTTMTEGIDNVRTIQDMFKKLGISESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 779 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacgtctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctgggtattcatgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgaaggcttcaaaaagcgtgttgcggcatgtctggataacgcccgctataccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 780 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYVSEDSHYSVYKNLRLLNMPHIMIKSQPNGEIDYGDLYETMRAHRDKPAIIFANIGTTMTEGIDNVRTIQDMFKKLGIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 781 - DNA, 1167 bp, synthetic construct
  misc_feature 1..1167: note = Variant of Leucine Decarboxylase
  source 1..1167: mol_type = other DNA
atgggtaatctggtctttccagatggcgcgttgagcccgaccgaccaacgccgtattgaagatgtgtatcagtacgttcgtgagcaatgcgacaccttcatcgggtatccgtgcaacatggactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcatcgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacaccacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 782 - protein, 389 aa, synthetic construct
  REGION 1..389: note = Variant of Leucine Decarboxylase
MGNLVFPDGALSPTDQRRIEDVYQYVREQCDTFIGYPCNMDFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 783 - DNA, 1167 bp, synthetic construct
  misc_feature 1..1167: note = Variant of Leucine Decarboxylase
  source 1..1167: mol_type = other DNA
atgggtaatctggtctttccagatggcgcgttgagcccgaccgaccaacgccgtattgaagatgtgtatcagtacgttcgtgagcaatgcgacaccttcatcgggtatccgtgcaacatggactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcatcgacaacgtgcgcaccatccaggatatgttcaagaagctggcgattcacgaatctcatatccattgtgacgcagcattatcggggatgaccctgccctttatggatgatgccccagcgtttgactttgccgatggcattgattcgcttagcatctccggtcacaaattcattgggtctccgatgccttgcggcatcgttttgacacgcaaaccttatgtggagaaaattgctacttcgattgaatatatcggtacccgcgacaccacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 784 - protein, 389 aa, synthetic construct
  REGION 1..389: note = Variant of Leucine Decarboxylase
MGNLVFPDGALSPTDQRRIEDVYQYVREQCDTFIGYPCNMDFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFADGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 785 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtattgaagatgtgtatcagtacgttcgtgagcaatgcgacaccttcatcgggtatccgtgcaacatggactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcatcgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacaccacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 786 - protein, 389 aa, synthetic construct
  REGION 1..389: note = Variant of Leucine Decarboxylase
MGNLKFPDGALSPTDQRRIEDVYQYVREQCDTFIGYPCNMDFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 787 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattgtggttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 788 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAIVVVFPKPPQSVLEKWQIATEGDDAHICLMPSTTRQMVDELIADIAAANKEAAAPSDTAK

SEQ ID NO: 789 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacattgcgcatatttgcttaatgccaagtaccacccgtcagatggtcgatgaattgatcgctgacattgcggccgccaataaagaagctgcggcaccgagcgatacggccaag

SEQ ID NO: 790 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDIAHICLMPSTTRQMVDELIADIAAANKEAAAPSDTAK

SEQ ID NO: 791 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccattaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 792 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPINNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 793 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaaattccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 794 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFANSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 795 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctttttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 796 - protein, 389 aa, synthetic construct
  REGION 1..389: note = Variant of Leucine Decarboxylase
MGNLKFPDGALSPTDQRRIEDVYQYVREQCDTFIGYPCNMHFDYTPFFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 797 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcgaggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 798 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFEAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 799 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgaccttgcgcatatttgcttaatgccaagtaccacccgtcagatggtcgatgaattgatcgctgacattgcggccgccaataaagaagctgcggcaccgagcgatacggccaag

SEQ ID NO: 800 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDLAHICLMPSTTRQMVDELIADIAAANKEAAAPSDTAK

SEQ ID NO: 801 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttccaggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 802 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFQAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 803 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcatggagcgatacggccaag

SEQ ID NO: 804 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAWSDTAK

SEQ ID NO: 805 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttcgttaatgccaagtaccacccgtcagatggtcgatgaattgatcgctgacattgcggccgccaataaagaagctgcggcaccgagcgatacggccaag

SEQ ID NO: 806 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 807 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatttgggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 808 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 809 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagcttcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 810 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 811 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacacccttatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 812 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 813 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaaacttcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 814 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSETSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 815 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccacggacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 816 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTTDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 817 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccgctgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 818 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTADTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 819 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattccgtatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 820 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIPYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 821 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaactatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgatggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgaaggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcaccgagcgatacggccaag

SEQ ID NO: 822 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 823 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 824 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 825 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 826 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 827 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 828 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 829 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 830 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 831 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 832 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 833 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 834 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 835 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 836 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 837 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 838 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 839 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 840 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 841 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 842 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 843 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 844 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 845 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 846 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 847 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 848 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 849 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 850 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 851 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccaattatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctactggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgacggcttcaaacgccgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 852 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSNYRIHTREIEREVLAWFAELMHIAPEEYWGYVTNGGSEGNLYGGFLARERFPTGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGRDGFKRRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 853 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccgccaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcgtcgccgagcgatacggccaag

SEQ ID NO: 854 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPPIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAASPSDTAK

SEQ ID NO: 855 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgagggcttcaaaaagcgtgttgcggcatgtctggataacgcccgctatgctgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccgagcgatacggccaag

SEQ ID NO: 856 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 857 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatggattttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcatcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacacgacgatttcgggcagccgtaatggtattacaccgctgtttctttggtacgcggttaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgccgagcgatacggccaag

SEQ ID NO: 858 - protein, 389 aa, synthetic construct
  REGION 1..389: note = Variant of Leucine Decarboxylase
MGNLKFPDGALSPTDQRRIEDVYQYVREQCDTFIGYPCNMDFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 859 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcttcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacgcgacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgccgagcgatacggccaag

SEQ ID NO: 860 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 861 - DNA, 1167 bp, synthetic construct
  misc_feature 1..1167: note = Variant of Leucine Decarboxylase
  source 1..1167: mol_type = other DNA
atgggtaatctggtctttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcttcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacgcgacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcgtcgccgagcgatacggccaag

SEQ ID NO: 862 - protein, 389 aa, synthetic construct
  REGION 1..389: note = Variant of Leucine Decarboxylase
MGNLVFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMPHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAASPSDTAK

SEQ ID NO: 863 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatggattttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcttcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacacgacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcgtcgccgagcgatacggccaag

SEQ ID NO: 864 - protein, 389 aa, synthetic construct
  REGION 1..389: note = Variant of Leucine Decarboxylase
MGNLKFPDGALSPTDQRRIEDVYQYVREQCDTFIGYPCNMDFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAASPSDTAK

SEQ ID NO: 865 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatggattttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcttcgctaacattggtacgacgatgaccgaaggcattgacaacctgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacgcgacgatttcgggcagccgtaatggtattacaccgctgtttctttggtacgcgattaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgccgagcgatacggccaag

SEQ ID NO: 866 - protein, 389 aa, synthetic construct
  REGION 1..389: note = Variant of Leucine Decarboxylase
MGNLKFPDGALSPTDQRRIEDVYQYVREQCDTFIGYPCNMDFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMPHIMIKSQPNGEIDYGDLYETMRAHRDKPAIIFANIGTTMTEGIDNLRTIQDMFKKLAIHESHIHCDAALSGMTLPFMDDAPAFDFATGIDSLSISGHKFIGSPMPCGIVLTRKPYVEKIATSIEYIGTRDATISGSRNGITPLFLWYAIKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 867 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatggattttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcatcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacacgacgatttcgggcagccgtaatggtattacaccgctgtttctttggtacgcgattaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgccgagcgatacggccaag

SEQ ID NO: 868 - protein, 389 aa, synthetic construct
  REGION 1..389: note = Variant of Leucine Decarboxylase
MGNLKFPDGALSPTDQRRIEDVYQYVREQCDTFIGYPCNMDFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMPHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAIKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 869 - DNA, 1167 bp, synthetic construct
  misc_feature 1..1167: note = Variant of Leucine Decarboxylase
  source 1..1167: mol_type = other DNA
atgggtaatctggtctttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcttcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacgcgacgatttcgggcagccgtaatggtattacaccgctgtttctttggtacgcggttaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcgtcgccgagcgatacggccaag

SEQ ID NO: 870 - protein, 389 aa, synthetic construct
  REGION 1..389: note = Variant of Leucine Decarboxylase
MGNLVFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAASPSDTAK

SEQ ID NO: 871 - DNA, 1167 bp, synthetic construct
  misc_feature 1..1167: note = Variant of Leucine Decarboxylase
  source 1..1167: mol_type = other DNA
atgggtaatctggtctttccagatggcgcgttgagcccgaccgaccaacgccgtattgaagatgtgtatcagtacgttcgtgagcaatgcgacaccttcatcgggtatccgtgcaacatggattttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcatcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacgcgacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcgtcgccgagcgatacggccaag

SEQ ID NO: 872 - protein, 389 aa, synthetic construct
  REGION 1..389: note = Variant of Leucine Decarboxylase
MGNLVFPDGALSPTDQRRIEDVYQYVREQCDTFIGYPCNMDFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAASPSDTAK

SEQ ID NO: 873 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatggattttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttttcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcttcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacacgacgatttcgggcagccgtaatggtattacaccgctgtttctttggtacgcggttaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgccgagcgatacggccaag

SEQ ID NO: 874 - protein, 389 aa, synthetic construct
  REGION 1..389: note = Variant of Leucine Decarboxylase
MGNLKFPDGALSPTDQRRIEDVYQYVREQCDTFIGYPCNMDFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMPHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 875 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcttcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacgcgacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgccgagcgatacggccaag

SEQ ID NO: 876 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMPHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 877 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgttaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgtttaatgccaagtaccacccgtcagatggtcgatgaattgatcgctgacattgcggccgccaataaagaagctgcggcatggagcgatacggccaag

SEQ ID NO: 878 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAWSDTAK

SEQ ID NO: 879 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcttcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacgcgacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcgtcgccgagcgatacggccaag

SEQ ID NO: 880 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAASPSDTAK

SEQ ID NO: 881 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatggattttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcatcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacacgacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgccgagcgatacggccaag

SEQ ID NO: 882 - protein, 389 aa, synthetic construct
  REGION 1..389: note = Variant of Leucine Decarboxylase
MGNLKFPDGALSPTDQRRIEDVYQYVREQCDTFIGYPCNMDFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMPHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 883 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatggattttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcttcgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacgcgacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcgtcgccgagcgatacggccaag

SEQ ID NO: 884 - protein, 389 aa, synthetic construct
  REGION 1..389: note = Variant of Leucine Decarboxylase
MGNLKFPDGALSPTDQRRIEDVYQYVREQCDTFIGYPCNMDFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAASPSDTAK

SEQ ID NO: 885 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatggattttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcttcgctaacattggtacgacgatgaccgaaggcattgacaacctgcgcaccatccaggatatgttcaagaagctggctatttcggaacaccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacgcgacgatttcgggcagccgtaatggtattacaccgctgtttctttggtacgcggttaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgccgagcgatacggccaag

SEQ ID NO: 886 - protein, 389 aa, synthetic construct
  REGION 1..389: note = Variant of Leucine Decarboxylase
MGNLKFPDGALSPTDQRRIEDVYQYVREQCDTFIGYPCNMDFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMPHIMIKSQPNGEIDYGDLYETMRAHRDKPAIIFANIGTTMTEGIDNLRTIQDMFKKLAISEHHIHCDAALSGMTLPFMDDAPAFDFATGIDSLSISGHKFIGSPMPCGIVLTRKPYVEKIATSIEYIGTRDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 887 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccaagcgatacggccaag

SEQ ID NO: 888 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 889 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccctgatcgggtatccgtgcaacatgcactttgattacacacctctttttccgttcctggcctatcccgttaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagtttaatgccaagtaccacccgtcagatggtcgatgaattgatcgctgacattgcggccgccaataaagaagctgcggcaccgagcgatacggccaag

SEQ ID NO: 890 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 891 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgtttaatgccaagtaccacccgtcagatggtcgatgaattgatcgctgacattgcggccgccaataaagaagctgcggcatggagcgatacggccaag

SEQ ID NO: 892 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPINNVGDPFANSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTRDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAWSDTAK

SEQ ID NO: 893 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccgtcaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccaagcgatacggccaag

SEQ ID NO: 894 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPVNNVGDPFANSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 895 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccgttaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccaagcgatacggccaag

SEQ ID NO: 896 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 897 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgtttaatgccaagtaccacccgtcagatggtcgatgaattgatcgctgacattgcggccgccaataaagaagctgcggcatggagcgatacggccaag

SEQ ID NO: 898 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFANSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTRDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAWSDTAK

SEQ ID NO: 899 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagattcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacacgacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccgagcgatacggccaag

SEQ ID NO: 900 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 901 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgttaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtacccgtgacactacgatttcgggcagccgtaatggtattacaccgctgtttctttggtacgcggtgaaacaagctggacgcgagggcttcaaaaagcgtgttgcggcatgtctggataacgcccgctatgctgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccaagcgatacggccaag

SEQ ID NO: 902 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 903 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccaagcgatacggccaag

SEQ ID NO: 904 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPINNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 905 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtaccacggacactacgatttcgggcagccgtaatggtattacaccgctgtttctttggtacgcggtgaaacaagctggacgcgagggcttcaaaaagcgtgttgcggcatgtctggataacgcccgctatactgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccgagcgatacggccaag

SEQ ID NO: 906 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTTDTTISGSRNGITPLFLWYAVKQAGREGFKKRVAACLDNARYTVEQFKRIGVEAMRNPCAITVVFPKPPQSVLEKWQIATEGDDAHISLMPSTTRQMVDELIADIAAANKEAAAPSDTAK

SEQ ID NO: 907 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagtttaatgccaagtaccacccgtcagatggtcgatgaattgatcgctgacattgcggccgccaataaagaagctgcggcatggagcgatacggccaag

SEQ ID NO: 908 - protein, 389 aa, synthetic construct
  REGION 1..389: note = Variant of Leucine Decarboxylase
MGNLKFPDGALSPTDQRRLEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAWSDTAK

SEQ ID NO: 909 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccctgatcgggtatccgtgcaacatgcactttgattacacacctctttttccgttcctggcctatcccgtcaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccgagcgatacggccaag

SEQ ID NO: 910 - protein, 389 aa, synthetic construct
  REGION 1..389: note = Variant of Leucine Decarboxylase
MGNLKFPDGALSPTDQRRLEDVYQYVREQCDTLIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 911 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatactgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcgccgagcgatacggccaag

SEQ ID NO: 912 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 913 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctgggtattcatgaacaccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtacccgtgacactacgatttcgggcagccgtaatggtattacaccgctgtttctttggtacgcggtgaaacaagctggacgcgagggcttcaaaaagcgtgttgcggcatgtctggataacgcccgctatactgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccgagcgatacggccaag

SEQ ID NO: 914 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLGIHEHHIHCDAALSGMTLPFMDDAPAFDFATGIDSLSISGHKFIGSPMPCGIVLTRKPYVEKIATSIEYLGTRDTTISGSRNGITPLFLWYAVKQAGREGFKKRVAACLDNARYTVEQFKRIGVEAMRNPCAITVVFPKPPQSVLEKWQIATEGDDAHICLMPSTTRQMVDELIADIAAANKEAAAPSDTAK

SEQ ID NO: 915 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccgttaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgtttaatgccaagtaccacccgtcagatggtcgatgaattgatcgctgacattgcggccgccaataaagaagctgcggcaccgagcgatacggccaag

SEQ ID NO: 916 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 917 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccaagcgatacggccaag

SEQ ID NO: 918 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 919 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgttaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccacggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcatggagcgatacggccaag

SEQ ID NO: 920 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTTDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAWSDTAK

SEQ ID NO: 921 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctgtttccgttcctggcctatcccgttaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgctgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagtttaatgccaagtaccacccgtcagatggtcgatgaattgatcgctgacattgcggccgccaataaagaagctgcggcaccaagcgatacggccaag

SEQ ID NO: 922 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPVNNVGDPFANSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 923 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctttttccgttcctggcctatcccgttaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccaagcgatacggccaag

SEQ ID NO: 924 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 925 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctgtttccgttcgaagcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtaccacggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgtttaatgccaagtaccacccgtcagatggtcgatgaattgatcgctgacattgcggccgccaataaagaagctgcggcaccaagcgatacggccaag

SEQ ID NO: 926 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFEAYPINNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTTDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 927 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccctgatcgggtatccgtgcaacatgcactttgattacacacctctttttccgttcctggcctatcccgttaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtaccacggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccaagcgatacggccaag

SEQ ID NO: 928 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTTDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 929 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccttcatcgggtatccgtgcaacatgcactttgattacacacctctgtttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtaccacggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgtttaatgccaagtaccacccgtcagatggtcgatgaattgatcgctgacattgcggccgccaataaagaagctgcggcaccaagcgatacggccaag

SEQ ID NO: 930 - protein, 389 aa, synthetic construct
  REGION 1..389: note = Variant of Leucine Decarboxylase
MGNLKFPDGALSPTDQRRLEDVYQYVREQCDTFIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTTDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 931 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccctgatcgggtatccgtgcaacatgcactttgattacacacctctttttccgttcctggcctatcccgttaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccacggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagtttaatgccaagtaccacccgtcagatggtcgatgaattgatcgctgacattgcggccgccaataaagaagctgcggcatggagcgatacggccaag

SEQ ID NO: 932 - protein, 389 aa, synthetic construct
  REGION 1..389: note = Variant of Leucine Decarboxylase
MGNLKFPDGALSPTDQRRLEDVYQYVREQCDTLIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTTDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAWSDTAK

SEQ ID NO: 933 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccctgatcgggtatccgtgcaacatgcactttgattacacacctctttttccgttcctggcctatcccgtcaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatctgggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgtttaatgccaagtaccacccgtcagatggtcgatgaattgatcgctgacattgcggccgccaataaagaagctgcggcaccaagcgatacggccaag

SEQ ID NO: 934 - protein, 389 aa, synthetic construct
  REGION 1..389: note = Variant of Leucine Decarboxylase
MGNLKFPDGALSPTDQRRLEDVYQYVREQCDTLIGYPCNMHFDYTPLFPFLAYPVNNVGDPFANSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYLGTRDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 935 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgcgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgtttaatgccaagtaccacccgtcagatggtcgatgaattgatcgctgacattgcggccgccaataaagaagctgcggcatggagcgatacggccaag

SEQ ID NO: 936 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAWSDTAK

SEQ ID NO: 937 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtattgaagatgtgtatcagtacgttcgtgagcaatgcgacaccttcatcgggtatccgtgcaacatgcactttgattacacacctctttttccgttcctggcctatcccgttaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccacggacactacgatttcgggcagccgtaatggtattacaccgctgtttctttggtacgcggtgaaacaagctggacgcgagggcttcaaaaagcgtgttgcggcatgtctggataacgcccgctatactgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgtttaatgccaagtaccacccgtcagatggtcgatgaattgatcgctgacattgcggccgccaataaagaagctgcggcatggagcgatacggccaag

SEQ ID NO: 938 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTTDTTISGSRNGITPLFLWYAVKQAGREGFKKRVAACLDNARYTVEQFKRIGVEAMRNPCAITVVFPKPPQSVLEKWQIATEGDEAHICLMPSTTRQMVDELIADIAAANKEAAAWSDTAK

SEQ ID NO: 939 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtctggaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgctgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccaagcgatacggccaag

SEQ ID NO: 940 - protein, 389 aa, synthetic construct
  REGION 1..389: note = Variant of Leucine Decarboxylase
MGNLKFPDGALSPTDQRRLEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 941 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagactcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccgagcgatacggccaag

SEQ ID NO: 942 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPVNNVGDPFASSSYRIHTREIEREVLAWFAELMHIAPEEYWGYVTNGGSEGNLYGGFLARERFPDGVAYFSEDSHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 943 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctttctttccgttcgaagcctatcccgttaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgtttaatgccaagtaccacccgtcagatggtcgatgaattgatcgctgacattgcggccgccaataaagaagctgcggcatggagcgatacggccaag

SEQ ID NO: 944 - protein, 389 aa, synthetic construct
  REGION 1..389: note = Variant of Leucine Decarboxylase
MGNLKFPDGALSPTDQRRIEDVYQYVREQCDTFIGYPCNMHFDYTPFFPFEAYPVNNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAWSDTAK

SEQ ID NO: 945 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccgtcaacaacgtgggcgatccgtttgcaagctccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtacccgtgacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccaagcgatacggccaag

SEQ ID NO: 946 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTRDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 947 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccttcatcgggtatccgtgcaacatgcactttgattacacacctctttttccgttcctggcctatcccgttaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggctttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccacggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgtttaatgccaagtaccacccgtcagatggtcgatgaattgatcgctgacattgcggccgccaataaagaagctgcggcaccaagcgatacggccaag

SEQ ID NO: 948 - protein, 389 aa, synthetic construct
  REGION 1..389: note = Variant of Leucine Decarboxylase
MGNLKFPDGALSPTDQRRIEDVYQYVREQCDTFIGYPCNMHFDYTPLFPFLAYPVNNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTTDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 949 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcgtggagcgatacggccaag

SEQ ID NO: 950 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAWSDTAK

SEQ ID NO: 951 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcaccaagcgatacggccaag

SEQ ID NO: 952 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 953 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcaccaagcgatacggccaag

SEQ ID NO: 954 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 955 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccaagcgatacggccaag

SEQ ID NO: 956 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 957 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcaccaagcgatacggccaag

SEQ ID NO: 958 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 959 - DNA, 1167 bp, synthetic construct
  misc_feature 1..1167: note = Variant of Leucine Decarboxylase
  source 1..1167: mol_type = other DNA
atgggtaatctggtgtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcgtggagcgatacggccaag

SEQ ID NO: 960 - protein, 389 aa, synthetic construct
  REGION 1..389: note = Variant of Leucine Decarboxylase
MGNLVFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAWSDTAK

SEQ ID NO: 961 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccaagcgatacggccaag

SEQ ID NO: 962 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 963 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagcttaatgccaagtaccacccgtcagatggtcgatgaattgatcgctgacattgcggccgccaataaagaagctgcggcgcctagcgatacggccaag

SEQ ID NO: 964 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 965 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagcttaatgccaagtaccacccgtcagatggtcgatgaattgatcgctgacattgcggccgccaataaagaagctgcggcaccaagcgatacggccaag

SEQ ID NO: 966 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 967 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagcttaatgccaagtaccacccgtcagatggtcgatgaattgatcgctgacattgcggccgccaataaagaagctgcggcgtggagcgatacggccaag

SEQ ID NO: 968 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAWSDTAK

SEQ ID NO: 969 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcgtcgcctagcgatacggccaag

SEQ ID NO: 970 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAASPSDTAK

SEQ ID NO: 971 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccaagcgatacggccaag

SEQ ID NO: 972 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIIANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 973 - DNA, 1167 bp, synthetic construct
  misc_feature 1..1167: note = Variant of Leucine Decarboxylase
  source 1..1167: mol_type = other DNA
atgggtaatctggtgtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcaccaagcgatacggccaag

SEQ ID NO: 974 - protein, 389 aa, synthetic construct
  REGION 1..389: note = Variant of Leucine Decarboxylase
MGNLVFPDGALSPTDQRRIEDVYQYVREQCDTLIGYPCNMHFDYTPLFPFEAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 975 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccaagcgatacggccaag

SEQ ID NO: 976 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 977 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccaagcgatacggccaag

SEQ ID NO: 978 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 979 - DNA, 1167 bp, synthetic construct
  misc_feature 1..1167: note = Variant of Leucine Decarboxylase
  source 1..1167: mol_type = other DNA
atgggtaatctggtgtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagcttaatgccaagtaccacccgtcagatggtcgatgaattgatcgctgacattgcggccgccaataaagaagctgcggcgcctagcgatacggccaag

SEQ ID NO: 980 - protein, 389 aa, synthetic construct
  REGION 1..389: note = Variant of Leucine Decarboxylase
MGNLVFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 981 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcaccaagcgatacggccaag

SEQ ID NO: 982 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIIANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 983 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcgcctagcgatacggccaag

SEQ ID NO: 984 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 985 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccaagcgatacggccaag

SEQ ID NO: 986 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 987 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcaccaagcgatacggccaag

SEQ ID NO: 988 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 989 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccaagcgatacggccaag

SEQ ID NO: 990 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 991 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcgtggagcgatacggccaag

SEQ ID NO: 992 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAWSDTAK

SEQ ID NO: 993 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcgtcgtggagcgatacggccaag

SEQ ID NO: 994 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIIANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAASWSDTAK

SEQ ID NO: 995 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccaagcgatacggccaag

SEQ ID NO: 996 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 997 - DNA, 1167 bp, synthetic construct
  misc_feature 1..1167: note = Variant of Leucine Decarboxylase
  source 1..1167: mol_type = other DNA
atgggtaatctggtgtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcgtcgtggagcgatacggccaag

SEQ ID NO: 998 - protein, 389 aa, synthetic construct
  REGION 1..389: note = Variant of Leucine Decarboxylase
MGNLVFPDGALSPTDQRRIEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAASWSDTAK

SEQ ID NO: 999 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcgtcgcctagcgatacggccaag

SEQ ID NO: 1000 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAASPSDTAK

SEQ ID NO: 1001 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcaccaagcgatacggccaag

SEQ ID NO: 1002 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 1003 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcgtcgtggagcgatacggccaag

SEQ ID NO: 1004 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAASWSDTAK

SEQ ID NO: 1005 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcaccaagcgatacggccaag

SEQ ID NO: 1006 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 1007 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcaccaagcgatacggccaag

SEQ ID NO: 1008 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 1009 - DNA, 1167 bp, synthetic construct
  misc_feature 1..1167: note = Variant of Leucine Decarboxylase
  source 1..1167: mol_type = other DNA
atgggtaatctggtgtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcgcctagcgatacggccaag

SEQ ID NO: 1010 - protein, 389 aa, synthetic construct
  REGION 1..389: note = Variant of Leucine Decarboxylase
MGNLVFPDGALSPTDQRRIEDVYQYVREQCDTLIGYPCNMDFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 1011 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccaagcgatacggccaag

SEQ ID NO: 1012 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 1013 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccaagcgatacggccaag

SEQ ID NO: 1014 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 1015 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgtggagcgatacggccaag

SEQ ID NO: 1016 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAWSDTAK

SEQ ID NO: 1017 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcgcctagcgatacggccaag

SEQ ID NO: 1018 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 1019 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcgtggagcgatacggccaag

SEQ ID NO: 1020 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAWSDTAK

SEQ ID NO: 1021 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgcctagcgatacggccaag

SEQ ID NO: 1022 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 1023 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcgtggagcgatacggccaag

SEQ ID NO: 1024 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAWSDTAK

SEQ ID NO: 1025 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcgtggagcgatacggccaag

SEQ ID NO: 1026 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAWSDTAK

SEQ ID NO: 1027 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcgcctagcgatacggccaag

SEQ ID NO: 1028 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 1029 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcgcctagcgatacggccaag

SEQ ID NO: 1030 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIIANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 1031 - DNA, 1167 bp, synthetic construct
  misc_feature 1..1167: note = Variant of Leucine Decarboxylase
  source 1..1167: mol_type = other DNA
atgggtaatctggtgtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcgtcgcctagcgatacggccaag

SEQ ID NO: 1032 - protein, 389 aa, synthetic construct
  REGION 1..389: note = Variant of Leucine Decarboxylase
MGNLVFPDGALSPTDQRRIEDVYQYVREQCDTLIGYPCNMDFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAASPSDTAK

SEQ ID NO: 1033 - DNA, 1167 bp, synthetic construct
  misc_feature 1..1167: note = Variant of Leucine Decarboxylase
  source 1..1167: mol_type = other DNA
atgggtaatctggtgtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcgtcgcctagcgatacggccaag

SEQ ID NO: 1034 - protein, 389 aa, synthetic construct
  REGION 1..389: note = Variant of Leucine Decarboxylase
MGNLVFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAASPSDTAK

SEQ ID NO: 1035 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagcttaatgccaagtaccacccgtcagatggtcgatgaattgatcgctgacattgcggccgccaataaagaagctgcggcaccaagcgatacggccaag

SEQ ID NO: 1036 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 1037 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagcttaatgccaagtaccacccgtcagatggtcgatgaattgatcgctgacattgcggccgccaataaagaagctgcggcaccaagcgatacggccaag

SEQ ID NO: 1038 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 1039 - DNA, 1167 bp, synthetic construct
  misc_feature 1..1167: note = Variant of Leucine Decarboxylase
  source 1..1167: mol_type = other DNA
atgggtaatctggtgtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcaccaagcgatacggccaag

SEQ ID NO: 1040 - protein, 389 aa, synthetic construct
  REGION 1..389: note = Variant of Leucine Decarboxylase
MGNLVFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 1041 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcgtcgcctagcgatacggccaag

SEQ ID NO: 1042 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAASPSDTAK

SEQ ID NO: 1043 - DNA, 1167 bp, synthetic construct
  misc_feature 1..1167: note = Variant of Leucine Decarboxylase
  source 1..1167: mol_type = other DNA
atgggtaatctggtgtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatattagcttaatgccaagtaccacccgtcagatggtcgatgaattgatcgctgacattgcggccgccaataaagaagctgcggcaccaagcgatacggccaag

SEQ ID NO: 1044 - protein, 389 aa, synthetic construct
  REGION 1..389: note = Variant of Leucine Decarboxylase
MGNLVFPDGALSPTDQRRIEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHISLMPSTTRQMVDELIADIAAANKEAAAPSDTAK

SEQ ID NO: 1045 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcgaggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccaagcgatacggccaag

SEQ ID NO: 1046 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFEAYPINNVGDPFASSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 1047 - DNA, 1167 bp, synthetic construct
  misc_feature 1..1167: note = Variant of Leucine Decarboxylase
  source 1..1167: mol_type = other DNA
atgggtaatctgaaatttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaaagccatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcgtcgcctagcgatacggccaag

SEQ ID NO: 1048 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAASPSDTAK

SEQ ID NO: 1049 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacaccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcaccaagcgatacggccaag

SEQ ID NO: 1050 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 1051 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagcttaatgccaagtaccacccgtcagatggtcgatgaattgatcgctgacattgcggccgccaataaagaagctgcgtcgcctagcgatacggccaag

SEQ ID NO: 1052 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAASPSDTAK

SEQ ID NO: 1053 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagcttaatgccaagtaccacccgtcagatggtcgatgaattgatcgctgacattgcggccgccaataaagaagctgcggcaccaagcgatacggccaag

SEQ ID NO: 1054 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 1055 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcaccaagcgatacggccaag

SEQ ID NO: 1056 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIFANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 1057 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatggactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatatttgcttaatgccaagtaccacccgtcagatggtcgatgaattgatcgctgacattgcggccgccaataaagaagctgcggcaccaagcgatacggccaag

SEQ ID NO: 1058 - protein, 389 aa, synthetic construct
  REGION 1..389: note = Variant of Leucine Decarboxylase
MGNLKFPDGALSPTDQRRIEDVYQYVREQCDTLIGYPCNMDFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHICLMPSTTRQMVDELIADIAAANKEAAAPSDTAK

SEQ ID NO: 1059 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgaggcgcatatttgcttaatgccaagtaccacccgtcagatggtcgatgaattgatcgctgacattgcggccgccaataaagaagctgcggcgcctagcgatacggccaag

SEQ ID NO: 1060 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIIANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDEAHICLMPSTTRQMVDELIADIAAANKEAAAPSDTAK

SEQ ID NO: 1061 - DNA, 1167 bp, synthetic construct
  misc_feature 1..1167: note = Variant of Leucine Decarboxylase
  source 1..1167: mol_type = other DNA
atgggtaatctgaagtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaagttccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcctcacatcatgatcaaatcacagccgaatggtgagattgattacggcgatctctacgaaactatgcgcgctcatcgtgataagccggcaatcatctttgctaacattggtacgacgatgaccgaaggcattgacaacgtgcgcaccatccaggatatgttcaagaagctggcgattcacgaacatcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacactacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagtttaatgccaagtaccacccgtcagatggtcgatgaattgatcgctgacattgcggccgccaataaagaagctgcggcaccaagcgatacggccaag

SEQ ID NO: 1062 - protein, 389 aa, synthetic construct
  REGION 1..389: note = Variant of Leucine Decarboxylase
MGNLKFPDGALSPTDQRRIEDVYQYVREQCDTLIGYPCNMHFDYTPLFPFLAYPINNVGDPFASSSYRIHTREIEREVLAWFAELMHIAPEEYWGYVTNGGSEGNLYGGFLARERFPDGVAYFSEASHYSVYKNLRLLNMPHIMIKSQPNGEIDYGDLYETMRAHRDKPAIIFANIGTTMTEGIDNVRTIQDMFKKLAIHEHHIHCDAALSGMTLPFMDDAPAFDFATGIDSLSISGHKFIGSPMPCGIVLTRKPYVEKIATSIEYIGTLDTTISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

SEQ ID NO: 1063 - DNA, 1167 bp, synthetic construct
  misc_feature 1..1167: note = Variant of Leucine Decarboxylase
  source 1..1167: mol_type = other DNA
atgggtaatctggtgtttccagatggcgcgttgagcccgaccgaccaacgccgtatcgaagatgtgtatcagtacgttcgtgagcaatgcgacaccctgatcgggtatccgtgcaacatgcactttgattacacacctctttttccgttcctggcctatcccattaacaacgtgggcgatccgtttgcaaattccagttatcgcatccatacccgtgaaatcgaacgcgaggttctggcgtggttcgccgaactcatgcacattgcaccagaagaatactggggttatgtgactaatggaggatcggagggcaacctgtacggtggttttttagcgcgtgaacgctttcctgacggcgtcgcctacttctcggaagcctcgcattatagcgtgtataagaatctgcgtctgctgaacatgcgtcacatcatgatcaaatcacagccgaatggtgagattgattacggcgatctctacgaaactatgcgcgctcatcgtgataagccggcaatcatcattgctaacattggtacgacgatgaccgaaggcattgacaacgtgcgcaccatccaggatatgttcaagaagctggcgattcacgaatctcatatccattgtgacgcagcattatcggggatgaccctgccctttatggatgatgccccagcgtttgactttgccactggcattgattcgcttagcatctccggtcacaaattcattgggtctccgatgccttgcggcatcgttttgacacgcaaaccttatgtggagaaaattgctacttcgattgaatatatcggtaccctggacgccacgatttcgggcagccgtaatggtattacaccgctgtttctttggtacgcggtgaaacaagctggacgcgagggcttcaaaaagcgtgttgcggcatgtctggataacgcccgctatgccgtcgagcagtttaaacgcatcggtgtagaagcgatgcgtaatccatgtgccattaccgttgtgttcccgaaacctccgcagtcagtgctggaaaagtggcaaatcgcaaccgagggcgacgatgcgcatattagcttaatgccaagtaccacccgtcagatggtcgatgaattgatcgctgacattgcggccgccaataaagaagctgcggcgcctagcgatacggccaag

SEQ ID NO: 1064 - protein, 389 aa, synthetic construct
  REGION 1..389: note = Variant of Leucine Decarboxylase
MGNLVFPDGALSPTDQRRIEDVYQYVREQCDTLIGYPCNMHFDYTPLFPFLAYPINNVGDPFANSSYRIHTREIEREVLAWFAELMHIAPEEYWGYVTNGGSEGNLYGGFLARERFPDGVAYFSEASHYSVYKNLRLLNMRHIMIKSQPNGEIDYGDLYETMRAHRDKPAIIIANIGTTMTEGIDNVRTIQDMFKKLAIHESHIHCDAALSGMTLPFMDDAPAFDFATGIDSLSISGHKFIGSPMPCGIVLTRKPYVEKIATSIEYIGTLDATISGSRNGITPLFLWYAVKQAGREGFKKRVAACLDNARYAVEQFKRIGVEAMRNPCAITVVFPKPPQSVLEKWQIATEGDDAHISLMPSTTRQMVDELIADIAAANKEAAAPSDTAK

What is claimed is:

1. An engineered leucine decarboxylase polypeptide comprising an amino acid sequence having at least 96% sequence identity to a reference sequence corresponding to SEQ ID NO: 828, wherein the amino acid sequence comprises at least one substitution according to 202H, 272A, 290I, or 383S, or combinations thereof, wherein the amino acid positions are relative to the reference sequence corresponding to SEQ ID NO: 828.

2. The engineered leucine decarboxylase polypeptide of claim 1, wherein the amino acid sequence of the engineered leucine decarboxylase polypeptide comprises the substitution according to 202H.

3. The engineered leucine decarboxylase polypeptide of claim 1, wherein the amino acid sequence of the engineered leucine decarboxylase polypeptide comprises the substitution according to 272A.

4. The engineered leucine decarboxylase polypeptide of claim 1, wherein the amino acid sequence of the engineered leucine decarboxylase polypeptide comprises the substitution according to 290I.

5. The engineered leucine decarboxylase polypeptide of claim 1, wherein the amino acid sequence of the engineered leucine decarboxylase polypeptide comprises the substitution according to 383S.

6. The engineered leucine decarboxylase polypeptide of claim 1, wherein the engineered leucine decarboxylase polypeptide exhibits increased leucine decarboxylase activity in a gastric environment compared to the leucine decarboxylase having the amino acid sequence corresponding to SEQ ID NO: 828.

7. The engineered leucine decarboxylase polypeptide of claim 1, wherein the amino acid sequence of the engineered leucine decarboxylase polypeptide comprises SEQ ID NO: 854, 860, 862, 864, 866, 868, 870, 872, 876, 880, 884, 886, 914, 950, 952, 954, 956, 958, 960, 962, 964, 966, 970, 972, 974, 982, 986, 988, 990, 994, 996, 998, 1000, 1002, 1004, 1008, 1014, 1018, 1020, 1022, 1024, 1028, 1030, 1032, 1034, 1036, 1042, 1044, 1048, 1052, 1054, 1058, 1060, 1062, or 1064.

8. A composition comprising at least one engineered leucine decarboxylase polypeptide of claim 1.

9. A pharmaceutical composition comprising at least one engineered leucine decarboxylase polypeptide of claim 1.

10. The pharmaceutical composition of claim 9, further comprising at least one pharmaceutically acceptable excipient and/or carrier.

11. A method of reducing plasma leucine, isoleucine, alloisoleucine and/or ketoisocaproic acid levels in a subject, comprising administering to a subject in need thereof an effective amount of an engineered leucine decarboxylase of claim 1.

12. A method of treating and/or decreasing a symptom of a disease or condition associated with elevated plasma leucine, isoleucine, alloisoleucine, methionine, and/or ketoisocaproic acid levels, comprising administering to a subject in need thereof an effective amount of an engineered leucine decarboxylase of claim 1 to decrease levels of plasma leucine, isoleucine, alloisoleucine, methionine, and/or ketoisocaproic acid in the subject, wherein treating is palliative or prophylactic treatment.

13. The method of claim 12, wherein the disease or condition associated with elevated plasma leucine, isoleucine, alloisoleucine, and/or ketoisocaproic acid levels is maple syrup urine disease, isovaleric acidemia or 3-methylcrotonyl-CoA carboxylase deficiency.

14. The method of claim 12, wherein the engineered leucine decarboxylase is administered at a dose of 1 mg/kg to 500 mg/kg, 1 mg/kg to 400 mg/kg, 1 mg/kg to 200 mg/kg, or 5 mg/kg to 200 mg/kg.

15. The method of claim 12, wherein the engineered leucine decarboxylase is administered at a dose of 1 mg/kg to less than 25 mg/kg.

16. The method of claim 12, wherein the dose is about 6.25 mg/kg to about 12.5 mg/kg.

17. The method of claim 12, wherein the engineered leucine decarboxylase is administered in an effective amount to reduce plasma leucine, ketoisocaproic acid, and methionine levels.

18. The method of claim 12, wherein the engineered leucine decarboxylase is administered immediately before, concurrently with, and/or immediately following ingestion of a meal containing protein.

19. The method of claim 12, wherein the subject is able to eat a diet that is less restricted in protein content compared to diets required by subjects who are afflicted with the disease or condition.

20. The method of claim 12, wherein the treating is palliative treatment.

* * * * *